(12) United States Patent
Sachdeva et al.

(10) Patent No.: US 7,424,370 B2
(45) Date of Patent: Sep. 9, 2008

(54) COMPUTATIONAL METHOD FOR IDENTIFYING ADHESIN AND ADHESIN-LIKE PROTEINS OF THERAPEUTIC POTENTIAL

(75) Inventors: Gaurav Sachdeva, Delhi (IN); Kaushal Kumar, Delhi (IN); Preti Jain, Delhi (IN); Samir K. Brahmachari, Delhi (IN); Srinivasan Ramachandran, Delhi (IN)

(73) Assignee: Council of Scientific and Industrial Research, New Delhi (IN)

( * ) Notice: Subject to any disclaimer, the term of this patent is extended or adjusted under 35 U.S.C. 154(b) by 166 days.

(21) Appl. No.: 11/052,554

(22) Filed: Feb. 7, 2005

(65) Prior Publication Data

US 2005/0288866 A1 Dec. 29, 2005

Related U.S. Application Data

(60) Provisional application No. 60/589,227, filed on Jul. 20, 2004.

(51) Int. Cl.
*G06F 17/11* (2006.01)
*G06F 17/50* (2006.01)
*G06F 19/00* (2006.01)

(52) U.S. Cl. .......................... 702/19; 530/350; 128/925
(58) Field of Classification Search .................. 702/19; 530/350
See application file for complete search history.

(56) References Cited

OTHER PUBLICATIONS

Hobohm et al. J. Mol Biol. (1995) 251,390-399.*
Zuegge et al. Gene,280, 19-26, 2001.*
Kovezdi et al. Med Res Rev 1999, 19: 249-69, 1999.*

* cited by examiner

*Primary Examiner*—Michael Borin
(74) *Attorney, Agent, or Firm*—Marshall, Gerstein & Borun LLP

(57) ABSTRACT

A computational method for identifying adhesin and adhesin-like proteins, said method comprising steps of computing the sequence-based attributes of a neural network software wherein the attributes are (i) amino acid frequencies, (ii) multiplet frequency, (iii) dipeptide frequencies, (iv),charge composition, and (v) hydrophobic composition, training the artificial neural Network (ANN) for each of the computed five attributes, and identifying the adhesin and adhesin-like proteins having probability of being an adhesin ($P_{ad}$) as $\geq 0.51$; a computer system for performing the method; and genes and proteins encoding adhesin and adhesin-like proteins.

13 Claims, 5 Drawing Sheets

Figure 1:
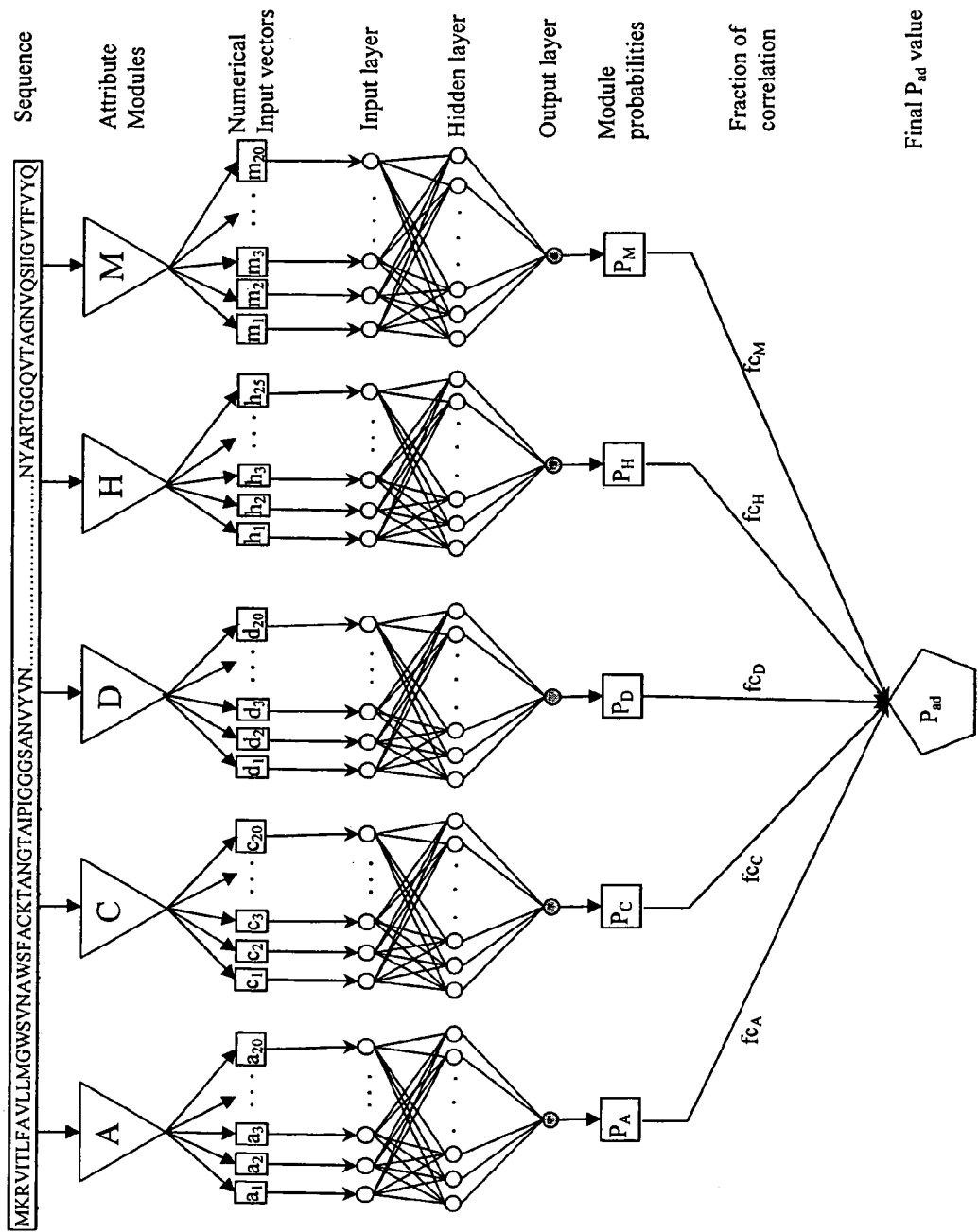

Figure 1 The Neural Network architecture

Figure 2:
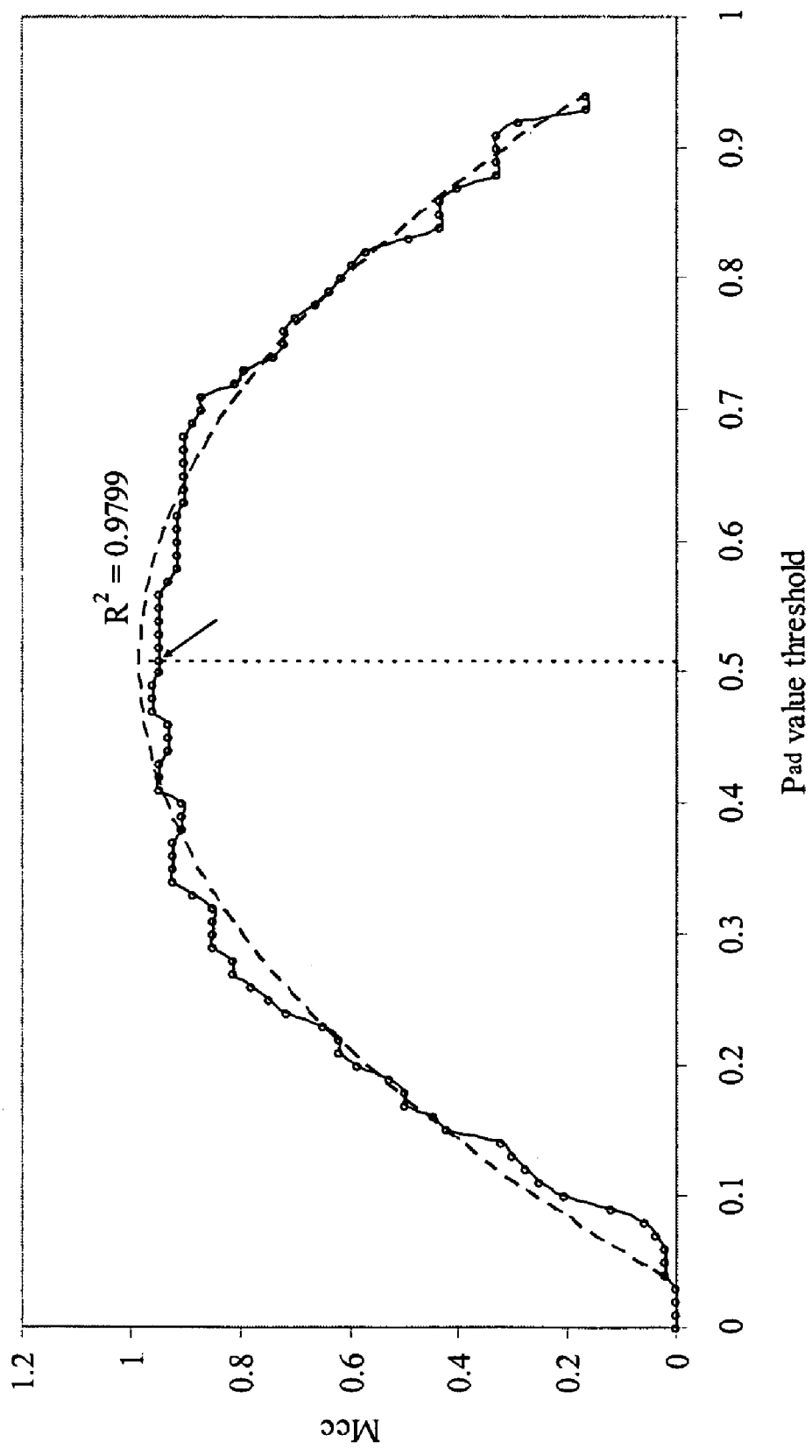

Figure 2 Assessment of SPAAN using defined test dataset.

COMPUTATIONAL METHOD FOR IDENTIFYING ADHESIN AND ADHESIN-LIKE PROTEINS OF THERAPEUTIC POTENTIAL

CROSS-REFERENCE TO OTHER APPLICATIONS

The present application claims the benefit of priority of each of the following applications: U.S., Provisional Application No. 06/589,220 filed on Jul. 20, 2004 and Indian Patent Application No. 173/DEL/2004 dated Feb. 6, 2004. The text of each of the aforementioned applications is specifically incorporated herein by reference.

The file copy of the sequence listing is submitted on a Compact-Disc Recordable (CD-R). The sequence listing is saved as an ASCII text file named 40359A.txt (2.8 1MB), which was created on May 18, 2005. The contents of the CD-R are incorporated herein by reference in its entirety.

FIELD OF THE PRESENT INVENTION

A computational method for identifying adhesin and adhesin-like proteins; computer system for performing the method; and genes and proteins encoding adhesin and adhesin-like proteins.

BACKGROUND AND PRIOR ART OF THE PRESENT INVENTION

The progress in genome sequencing projects has generated a large number of inferred protein sequences from different organisms. It is expected that the availability of the information on the complete set of proteins from infectious human pathogens will enable us to develop novel molecular approaches to combat them. A necessary step in the successful colonization and subsequent manifestation of disease by microbial pathogens is the ability to adhere to host cells.

Microbial pathogens encode several proteins known as adhesins that mediate their adherence to host cell surface receptors, membranes, or extracellular matrix for successful colonization. Investigations in this primary event of host-pathogen interaction over the past decades have revealed a wide array of adhesins in a variety of pathogenic microbes. Presently, substantial information on the biogenesis of adhesins and the regulation of adhesin factors is available. One of the best understood mechanisms of bacterial adherence is attachment mediated by pili or fimbriae. Several afimbrial adhesins also have been reported. In addition, limited knowledge on the target host receptors also has been gained (Finlay, B. B. and Falkow, S 1997).

New approaches to vaccine development focus on targeting adhesins to abrogate the colonization process (Wizemann, et al 1999). However, the specific role of particular adhesins has been difficult to elucidate. Thus, prediction of adhesins or adhesin-like proteins and their functional characterization is likely to aid not only in deciphering the molecular mechanisms of host pathogen interaction but also in developing new vaccine formulations, which can be tested in suitable experimental model systems.

One of the best understood mechanisms of bacterial adherence is attachment mediated by pili or fimbriae. For example, FimH and PapG adhesins of *Escherichia coli* (Maurer, L., Orndorff, P. (1987), Bock, K., et al. (1985). Other examples of pili group adhesins include type IV pili in *Pseudomonas aeruginosa*, *Neisseria* species, *Moraxella* species, Enteropathogenic *Escherichia coli* and *Vibrio cholerae* (Sperandio V et al (1996). Several afimbrial adhesins are HMW proteins of *Haemophilus influenzae* (van Schilfgaarde 2000), the filamentous hemagglutinin, pertactin, of *Bordetella pertussis* (Bassinet et al 2000), the BabA of *H. pylori* (Yu J et al 2002) and the YadA adhesin of *Yersinia enterocolitica* (Neubauer et al 2000). The intimin receptor protein (Tir) of Enteropathogenic *E. coli* (EPEC) is another type of adhesin (Ide T et al 2003). Other class of adhesins includes MrkD protein of *Kleibsella pneumoniae*, Hia of *H. influenzae* (St Geme et al 2000), Ag I/II of *Streptococcus mutans* and SspA, SspB of *Streptococcus gordonii* (Egland et al 2001), FnbA, FnbB of *Staphylococcus aureus* and SfbI, protein F of *Streptococcus pyogenes*, the PsaA of *Streptococcus pneumoniae* (De et al 2003).

A known example of adhesins approved as vaccine is the acellular pertussis vaccine containing FHA and pertactin against *B. pertussis* the causative agent of whooping cough (Halperin, S et al 2003). Immunization with FimH is being evaluated for protective immunity against pathogenic *E. coli* (Langermann S et al 2000), in *Streptococcus pneumoniae*, PsaA is being investigated as a potential vaccine candidate against pneumococcal disease (Rapola, S et al 2003). Immunization results with BabA adhesin showed promise for developing a vaccine against *H. pylori* (Prinz, C et al 2003). A synthetic peptide sequence anti-adhesin vaccine is being evaluated for protection against *Pseudomonas aeruginosa* infections.

Screening for adhesin and adhesin like proteins by conventional experimental method is laborious, time consuming and expensive. As an alternative, homology search is used to facilitate the identification of adhesins. Although, this procedure is useful in the analysis of genome organization (Wolf et al 2001) and of metabolic pathways. (Peregrin-Alvarez et al 2003, Rison et al 2002), it is somewhat limited in allowing functional predictions when the homologues are not functionally characterized or the sequence divergence is high. Assignment of functional roles to proteins based on this technique has been possible for only about 60% of the predicted protein sequences (Fraser et al 2000). Thus, we explored the possibility of developing a non-homology method based on sequence composition properties combined with the power of the Artificial Neural Networks to identify adhesins and adhesin-like proteins in species belonging to wide phylogenetic spectrum.

Twenty years ago, Nishikawa et al carried out some of the early attempts to classify proteins into different groups based on compositional analysis (Nishikawa et al 1983). More recently, the software PropSearch was developed for analyzing protein sequences where conventional alignment tools fail to identify significantly similar sequences (Hobohm, U. and Sander, C 1995). PropSearch uses 144 compositional properties of protein sequences to detect possible structural or functional relationships between a new sequence and sequences in the database. Recently the compositional attributes of proteins have been used to develop softwares for predicting secretory proteins in bacteria and apicoplast targeted proteins in *Plasmodium falciparum* by training Artificial Neural Networks (Zuegge et al 2001).

Zuegge et al have used the 20 amino acid compositional properties. Their objective was to extract features of apicoplast targeted proteins in *Plasmodium falciparum*. This is distinct from our software SPAAN that focuses on adhesins and adhesin-like proteins involved in host-pathogen interaction.

Hobohm and Sander have used 144 compositional properties including isoelectric point and amino acid and dipeptide composition to generate hypotheses on putative functional role of proteins that are refractory to analysis using other sequence alignment based approaches like BLAST and FASTA. Hobohm and Sander do not specifically address the issue of adhesins and adhesin-like proteins, which is the focus of SPAAN. Nishikawa et al had originally attempted to classify proteins into various functional groups. This was a curiosity driven exercise but eventually lead to the development of a software to discriminate extra-cellular proteins from intracellular proteins. This work did not address the issue of adhesins and adhesin-like proteins, which is the focus of SPAAN.

Thus, none of the aforementioned research groups have been able to envisage the methodology of the instant application. The inventive method of this application provides novel proteins and corresponding gene sequences.

Adhesins and adhesin-like proteins mediate host-pathogen interactions. This is the first step in colonization of a host by microbial pathogens. Attempts Worldwide are focused on designing vaccine formulations comprising adhesin proteins derived from pathogens. When immunized, host will have its immune system primed against adhesins for that pathogen. When a pathogen is actually encountered, the surveillance mechanism will recognize these adhesins, bind them through antigen-antibody interactions and neutralize the pathogen through complement mediate cascade and other related clearance mechanisms. This strategy has been successfully employed in the case of Whooping cough and is being actively pursued in the case of Pneumonia, Gastric Ulcer and Urinary tract infections.

OBJECTS OF THE PRESENT INVENTION

The main object of the present invention is to provide a computational method for identifying adhesin and adhesin-like proteins of therapeutic potential.

Another object of invention is to provide a method for screening the proteins with unique compositional characteristics as putative adhesins in different pathogens.

Yet, another object of the invention is providing the use of gene sequences encoding the putative adhesin proteins useful as preventive therapeutics.

SUMMARY OF THE PRESENT INVENTION

A computational method for identifying adhesin and adhesin-like proteins, said method comprising steps of computing the sequence-based attributes of protein sequences using five attribute modules of software SPAAN, (i) amino acid frequencies, (ii) multiplet frequency, (iii) dipeptide frequencies, (iv) charge composition, and (v) hydrophobic composition, training the artificial neural Network (ANN) for each of the computed five attributes, and identifying the adhesin and adhesin-like proteins having probability of being an adhesin ($P_{ad}$) as $\geq 0.51$; a computer system for performing the method; and genes and proteins encoding adhesin and adhesin-like proteins

DETAILED DESCRIPTION OF THE PRESENT INVENTION

Accordingly, the present invention relates to a computational method for identifying adhesin and adhesin-like proteins, said method comprising steps of computing the sequence-based attributes of protein sequences using five attribute modules of software SPAAN, (i) amino acid frequencies, (ii) multiplet frequency, (iii) dipeptide frequencies, (iv) charge composition, and (v) hydrophobic composition, training the artificial neural Network (ANN) for each of the computed five attributes, and identifying the adhesin and adhesin-like proteins having probability of being an adhesin ($P_{ad}$) as $\geq 0.51$; a computer system for performing the method; and genes and proteins encoding adhesin and adhesin-like proteins In an embodiment of the present invention, wherein the invention relates to a computational method for identifying adhesin and adhesin-like proteins, said method comprising steps of:
  a. computing the sequence-based attributes of protein sequences using five attribute modules of a neural network software, wherein the attributes are software, (i) amino acid frequencies, (ii) multiplet frequency, (iii) dipeptide frequencies, (iv) charge composition, and (v) hydrophobic composition,
  b. training the artificial neural Network (ANN) for each of the computed five attributes, and
  c. identifying the adhesin and adhesin-like proteins having probability of being an adhesin ($P_{ad}$) as $\geq 0.51$.

In another embodiment of the present invention, wherein the invention relates to a method wherein the protein sequences is obtained from pathogens, eukaryotes, and multicellular organisms.

In an embodiment of the present invention, wherein the invention relates to a method, wherein the protein sequences are obtained from the pathogens selected from a group of organisms comprising *Escherichia coli, Haemophilus influenzae, Helicobacter pylori, Mycoplasma pneumoniae, Mycobacterium tuberculosis, Rickettsiae prowazekii, Porphyromonas gingivalis, Shigella flexneri, Streptococcus mutans, Streptococcus pneumoniae, Neisseria men ingitides, Streptococcus pyogenes, Treponema pallidum* and Severe Acute Respiratory Syndrome associated human coronavirus (SARS).

In yet another embodiment of the present invention, wherein the method of the invention is a non-homology method.

In still another embodiment of the present invention, wherein the invention relates to the method using 105 compositional properties of the sequences.

In still another embodiment of the present invention, wherein the invention relates to a method showing sensitivity of at least 90%.

In still another embodiment of the present invention, wherein the invention relates to the method showing specificity of 100%.

In still another embodiment of the present invention, wherein the invention relates to a method identifying adhesins from distantly related organisms.

In still another embodiment of the present invention, wherein the invention relates to the neural network has multi-layer feed forward topology, consisting of an input layer, one hidden layer, and an output layer.

In still another embodiment of the present invention, wherein the invention relates to the number of neurons in the input layer are equal to the number of input data points for each attribute.

In still another embodiment of the present invention, wherein the invention relates to the "$P_{ad}$" is a weighted linear sum of the probabilities from five computed attributes. In still another embodiment of the present invention, wherein the invention relates to each trained network assigns a probability value of being an adhesin for the protein sequence.

In still another embodiment of the present invention, wherein the invention relates to a computer system for performing the method of claim 1, said system comprising a central processing unit, executing SPAAN program, giving probabilities based on different attributes using Artificial Neural Network and in built other programs of assessing attributes, all stored in a memory device accessed by CPU, a display on which the central processing unit displays the screens of the above mentioned programs in response to user inputs; and a user interface device.

In still another embodiment of the present invention, wherein the invention relates to a set of 274 annotated genes encoding-adhesin and adhesin-like proteins, having SEQ ID Nos. 385 to 658.

In still another embodiment of the present invention, wherein the invention relates to a set of 105 hypothetical genes encoding adhesin and adhesin-like proteins, having SEQ. ID Nos. 659 to 763.

In still another embodiment of the present invention, wherein the invention relates to a set of 279 annotated adhesin and adhesin-like proteins of SEQ ID Nos. 1 to 279.

In still another embodiment of the present invention, wherein the invention relates to a set of 105 hypothetical adhesin and adhesin-like proteins of SEQ ID Nos. 280 to 384.

One more embodiment of the present invention, wherein the invention also relates to a fully connected multilayer feed forward Artificial Neural Network based on the computational method as claimed in claim 1, comprising of an input layer, a hidden layer and an output layer which are connected in the said sequence, wherein each neuron is a binary digit number and is connected to each neuron of the subsequent layer for identifying adhesin or adhesin like proteins, wherein the program steps comprise: [a] feeding a protein sequence in FASTA format; [b] processing the sequence obtained in step [a] through the 5 modules named A, C, D, H and M, wherein attribute. A represents an amino acid composition, attribute C represents a charge composition, attribute D represents a dipeptide composition of the 20 dipeptides [NG, RE, TN, NT, GT, TT, DE, ER, RR, RK, RI, AT, TS, IV, SG, GS, TG, GN, VI and HR], attribute H represents a hydrophobic composition and attribute M represents amino acid frequencies in multiplets to quantify 5 types of compositional attributes of the said protein sequence to obtain numerical input vectors respectively for each of the said attributes wherein the sum of numerical input vectors is 105; [c] processing of; the numerical input vectors obtained in step [b] by,the input neuron layer to obtain signals, wherein the number of neurons is equal to the number of numerical input vectors for each attribute; [d] processing of signals obtained from step [c] by the hidden layer to obtain synaptic weighted signals, wherein the optimal number of neurons in the hidden layer was determined through experimentation for minimizing the error at the best epoch for each network individually; [e] delivering synaptic weighted signals obtained from step [d] to the output layer for assigning of a probability value for each protein sequence fed in step [a] as being an adhesin by each network module; [f] using the individual probabilities obtained from step [e] for computing the final probability of a protein sequence being an adhesin denoted by the $P_{ad}$ value, which is a weighted average of the individual probabilities obtained from step [e] and the associated fraction of correlation which is a measure of the strength of the prediction.

In still another embodiment of the present invention, wherein the input neuron layer consists of a total of 105 neurons corresponding to 105 compositional properties.

In still another embodiment of the present invention, wherein the hidden layer comprises of neurons represented as 30 for amino acid frequencies, 28 for multiplet frequencies, 28 for dipeptide frequencies, 30 for charge composition and 30 for hydrophobic composition.

In still another embodiment of the present invention, wherein the output layer comprises of neurons to deliver the output values as probability value for each protein sequence.

Identification of novel adhesins and their characterization are important for studying host-pathogen interactions and testing new vaccine formulations. We have employed Artificial Neural Networks to develop an algorithm SPAAN (Software for Prediction of Adhesin and Adhesin-like proteins using Neural Networks) that can identify adhesin proteins using 105 compositional properties of a protein sequence. SPAAN could correctly predict well characterized adhesins from several bacterial species and strains. SPAAN showed 89% sensitivity and 100% specificity in a test data set that did not contain proteins in the training set. Putative adhesins identified by the software can serve as potential preventive therapeutics.

The present invention provides a novel computational method for identifying adhesin and adhesin-like proteins of therapeutic potential. More particularly, the present invention relates to candidate genes for these adhesins. The invention further provides new leads for development of candidates genes, and their encoded proteins in their functional relevance to preventive approaches. This computational method involves calculation of several sequence attributes and their subsequent analyses lead to the identification of adhesin proteins in different pathogens. Thus, the present invention is useful for identification of the adhesin proteins in pathogenic organisms. The adhesin proteins from different genomes constitute a set of candidates for functional characterization through targeted gene disruption, microarrays and proteomics. Further, these proteins constitute a set of candidates for further testing in development of preventive therapeutics. Also, are provided the genes encoding the candidate adhesin proteins.

The present method offers novelty in the principles used and the power of Neural Networks to identify new adhesins compared to laborious and time consuming conventional methods. The present method is based on compositional properties of proteins instead of sequence alignments. Therefore this method has the ability to identify adhesin and adhesin like proteins from bacteria belonging to a wide phylogenetic spectrum. The predictions made from this method are readily verifiable through independent analysis and experimentation. The invention has the potential to accelerate the development of new preventive therapeutics, which currently requires high investment in terms of requirement of skilled labor and valuable time.

The present invention relates to a computational method for the identification of candidate adhesin proteins of therapeutic potential. The invention particularly describes a novel method to identify adhesin proteins in different genomes of pathogens. These adhesin proteins can be used for developing preventive therapeutics.

Accordingly, a computational method for identifying adhesin and adhesin-like proteins of therapeutic potential which comprises calculation of 105 compositional properties under the five sequence attributes, namely, Amino Acid frequency, Multiplet frequency, dipeptide frequency, charge composition and hydrophobic composition; and then training Artificial Neural Network (ANN, Feed Forward Error Back Propagation) using these properties for differentiating between adhesin and non-adhesin class of proteins. This computational method involves quantifying 105 compositional attributes of query proteins and qualifying them as adhesins or non-adhesins by a $P_{ad}$ value (Probability of being an adhesin). The present invention is useful for identification of adhesin and adhesin-like proteins in pathogenic organisms.

These newly identified adhesin and adhesin-like proteins constitute a set-of candidates for development of new preventive therapeutics that can be tested in suitable experimental model systems readily. In addition, the genes encoding the candidate adhesin and adhesin-like proteins are provided.

The invention provides a set of candidate adhesin and adhesin-like proteins and their coding genes for further evaluation as preventive therapeutics. The method of invention is based on the analysis of protein sequence attributes instead of sequence patterns classified to functional domains. Present method is less dependent on sequence relationships and therefore offers the potential power of identifying adhesins from distantly related organisms. The invention provides a computational method, which involves prediction of adhesin and adhesin-like proteins using Artificial Neural Networks. The proteins termed adhesin were found to be predicted with a high probability ($P_{ad} \geq 0.51$) in various pathogens. Some adhesin sequences turned out to be identical or homologous to proteins that are antigenic or implicated in virulence. By this approach, proteins could be identified and short-listed for further testing in development of new vaccine formulations to eliminate diseases caused by various pathogenic organisms.

DESCRIPTION OF TABLES

Table 1: Output file format given by SPAAN.
Table 2: Organism Name, Accession number, Number of base pairs, Date of release and Total number of proteins.
Table 3. Prediction of well characterized adhesins from various bacterial pathogens using SPAAN.
Table 4. Analysis of predictions made by SPAAN on genome scans of a few selected pathogenic organisms.
Table 5: GI numbers and Gene IDs of new putative adhesins predicted by SPAAN in the genomes listed in Table 2.
Table 6: GI numbers and Gene IDs of hypothetical proteins predicted as putative adhesins by SPAAN in the genomes listed in Table 2.
Table 7: The list of 198 adhesins found in bacteria

BRIEF DESCRIPTION OF THE ACCOMPANYING DRAWINGS

Figure 3:
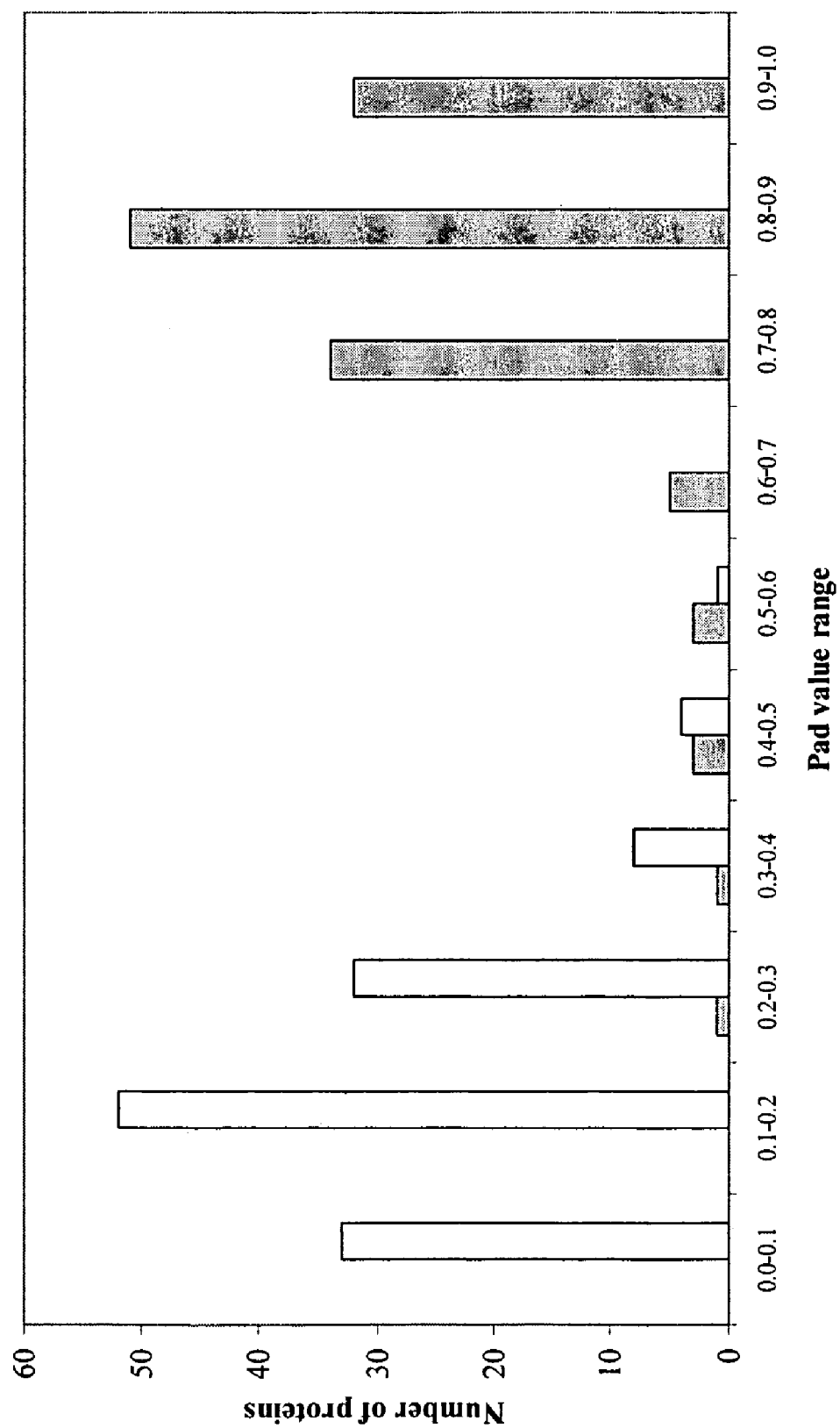
Figure 3:
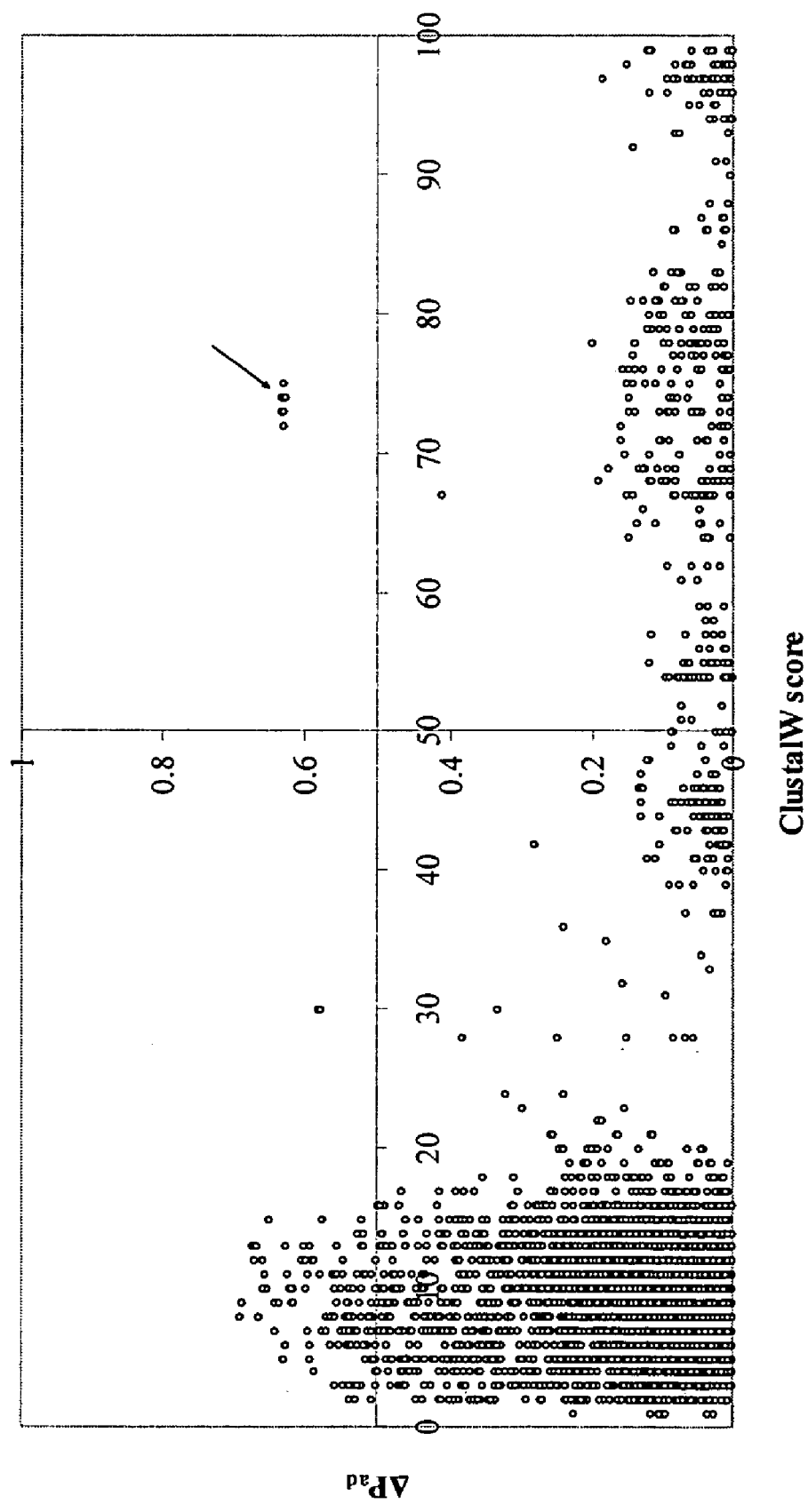

FIG. 1, shows the Neural Network architecture
FIG. 2 shows assessment of SPAAN using defined test dataset.
FIG. 3(*a*) shows Histogram plots of the number of proteins in the various $P_{ad}$ value ranges are shown. (*b*) Pairwise sequence relationships among the adhesins were determined using CLUSTAL W and plotted on X-axis. Higher scores indicate similar pairs. (*c*) plot for non-adhesins. Data are plotted in the 4 quadrant format for clear inspection.

Software program was written in C Language and operated on Red Hat Linux 8.0 operating system. The computer program accepts input protein sequences in FastA format and produces a tabulated output. The output Table contains one row for each protein listing the probability outputs of each of the five modules, a weighted average probability of these five modules ($P_{ad}$), and the function of the protein as described in the input sequence file. This software is called SPAAN (A Software for Prediction of Adhesins and Adhesin-like proteins using Neural Networks) and a software copyright has been filed. Although this software has multiple modules, the running of these modules have been integrated and automated. The user only needs to run one command.

AAcompo.c:
  Input: File containing protein sequences in the fasta format.
  Output: File containing frequencies of all 20 AAs for each protein in one row.
charge.c:
  Input: File containing protein sequences in the fasta format.
  Output: File containing frequency of charged amino acids (R, K, E and D) and moments (up to 18th order) of the positions of charged amino acids.
hdr.c:
  Input: File containing protein sequences in the fasta format.
  Output: File containing frequencies of 5 groups of amino acids formed on the basis their Hydrophobicity and moments of their positions up to 5th order.
multiplets.c:
  Input: File containing protein sequences in the fasta format.
  Output: File containing fractions of multiplets of each of the 20 amino acids.
quetydipep.c:
  Input: File. 1 containing protein sequences in the fasta format.
    File.2 containing list of the significant dipeptides in dipeptide analysis.
  Output: File containing frequencies of the dipeptides listed in the input File.2 for each protein in the input File. 1.
train.c:
  Input: File containing following specifications
    1. Number of input and output parameters.
    2. Number of nodes in the hidden layers.
    3. Names of the training, validate and test data files.
    4. Learning rate, coefficient of moment.
    5. Maximum number of cycles for training.
  Output: Outputs are as follows.
    1. Output of the trained NN for the test data set.
    2. Values of the weight connections in the trained NN.
    3. Some extra information about training.
recognize.c:
  Input: File containing following specifications
    1. Number of input and output parameters.
    2. Number of nodes in the hidden layers.
    3. Names of the query input file.
    4. Name of the file containing values of the weight connections for trained NN.
    5. Name of the output file.
  Output: Outputs for the query entries calculated by the trained NN.
standard.c:
  Input: File containing protein sequences in fasta format.
  Output: File containing protein sequences in fasta format with all the new line characters removed lying within a sequence.
filter.c:
  Input: File containing protein sequences in fasta format.
  Output: File containing protein sequences from the input except those which are short in length (<50 AAs) and which contain any amino acid other than the 20 known amino acids.

The Five Attributes:

Amino Acid Frequencies
  Amino acid frequency $f_i$=(counts of ith amino acid in the sequence)/1; i, =1 . . . 20, 1 is the length of the protein.

Multiplet Frequency
  Multiplets are defined as homopolymeric stretches $(X)_n$ where X is any of the 20 amino acids and n is an integer >2.

After identifying all the multiplets, the frequencies of the amino acids in the multiplets were computed as $f_i(m)$=(counts of $i^{th}$ amino acid occurring as multiplet)/1

Dipeptide Frequencies

The frequency of a dipeptide (i, j) $f_{ij}$=(counts of $ij^{th}$ dipeptide)/(total dipeptide counts); i, j ranges from 1 to 20.

It has been found that dipeptide repeats in proteins are important for functional expression of the clumping factor present on *Staphylococcus aureus* cell surface that binds to fibrinogen (Hartford et al 1999). Thus we included the dipeptide frequency module. The total number of dipeptides is 400. For optimal training of Neural Network, the ratio of total number of input vectors to the total number of weight connections must be around 2 to avoid over fitting (Andrea et al). Therefore, we identified the dipeptides whose frequencies in the adhesin data set (469 proteins, see database construction) were significantly different from that in the non-adhesin dataset (703 proteins) using t-test. The frequencies of top 20 dipeptides (when arranged in the descending order of the p-values of t-test), were fed to the Neural Network. These dipeptides were (using single letter IUPAC-IUB code) NG, RE, TN, NT, GT, TT, DE, ER, RR, RK, RI, AT, TS, IV, SG, GS, TG, GN, VI, AND HR. With frequency inputs for 20 dipeptides and 28 neurons in the 2nd layer, the total number of weight connections is 588, and is in keeping with the criterion of avoiding over fitting.

Charge Composition

The input frequency of charged amino acids (R, K, E and D considering the ionization properties of the side chains at pH 7.2) given by $f_c$=(counts of charged amino acids)/1 Further, information on the characteristics of the distribution of the charged amino acids in a given protein sequence was provided by computing the moments of the positions of the occurrences of the charged amino acids. Since moments characterize the patterns of distribution such as skewness and kurtosis (sharpness of the peak) we have used them to represent the distribution patterns of the charged residues in the sequence.

The general expression to compute moments of a given order; say 'i' is $$M_r = r^{th} \text{ order moment of the positions of charged amino acids}$$
$$= \sum \frac{(X_i - X_m)^r}{N}$$

Where, $X_m$=mean of all positions of charged amino acids
$X_i$=position of $i^{th}$ charged amino acid
N=number of charged amino acids in the sequence The moments $2^{nd}$ to $19^{th}$ order were used to train the ANN constituting a total 20 inputs in addition to frequency of charged amino acids and the length of the protein. The upper limit of $19^{th}$ order was set based on assessments of sensitivity and specificity on a small dataset of adhesins and non-adhesins. Moments of order greater than 19 were not useful in improvement of performance.

Hydrophobic Composition

A given protein sequence was digitally transformed using the hydrophobic scores of the amino acids according to Brendel et al. (43). The scores for five groups of amino acids: (−8 for K, E, D, R), (−4 for S, T, N, Q), (−2 for P, H), (+1 for A, G, Y, C, W), (+2 for L, V, I, F, M).

Following inputs were given for each of the group
(a) $f_i$=(counts of $i^{th}$ group)/(total counts in the protein); i ranges from 1 to 5
(b) $m_{ji}$=$j^{th}$ order moment of positions of amino acids in $i^{th}$ group; j ranges from 2 to 5.

A total of 25 inputs representing the hydrophobic composition of a protein were fed to the Neural Network. The rationale for using moments was same as described in the section on charge composition inputs.

Taken together a total of 105 compositional properties of a given protein sequence Were used to predict their adhesin characteristics.

The software PropSearch uses 144. compositional properties of protein sequences to detect possible structural or functional relationships between a new sequence and sequences in the database (Hobohm and Sander 1995). The approach defines protein sequence dissimilarity (or distance) as a weighted sum of differences of compositional properties such as singlet and doublet amino acid composition, molecular weight, isoelectric point (protein property search or PropSearch). Compositional properties of proteins have also been used for predicting secretory proteins in bacteria and apicoplast targeted proteins in Plasmodium falciparum (Zuegge, et al. 2001). The properties used here are statistical methods, principal component analysis, self-organizing maps, and supervised neural networks. In SPAAN, we have used 105 compositional properties in the five modules viz. Amino Acid frequencies, Multiplet frequencies, Dipeptide frequencies, Charge composition, Hydrophobic composition. The total of 105 properties used in SPAAN are 20 for Amino acid frequencies, 20 for Multiplets frequencies, 20 for Dipeptide frequencies (Top 20 significant dipeptides are used, based on t-test), 20 for Charge composition (frequency of charged amino acids (R, K, E and D) and moments of 2nd to 19th order), and 25 for Hydrophobic composition (Amino acids were classified into five groups (−8 for K, E, D, R), (−4 for S, T, N, Q), (−2 for P, H), (+1 for A, G, Y, C, W), (+2 for L, V, I, F, M). A total of 25 inputs consisted of the following: Frequency of each group, Moments of positions of amino acids in each group from 2nd to 5th order.

Neural Network

A feed forward error back propagation Neural Network was used. The program is a kind gift from Charles W. Anderson, Department of Computer Science, Colorado State University, Fort Collins, Colo. 80523, anderson@cs.colostate.edu Neural Network Architecture The Neural Network used here has a multi-layer feed-forward topology. It consists of an input layer, one hidden layer and an output layer. This is a 'fully-connected' Neural Network where each neuron i is connected to each unit j of the next layer (FIG. 1). The weight of each-connection is denoted by $w_{ij}$. The state $I_i$ of each neuron in the input layer is assigned directly from the input data, whereas the states of hidden layer neurons are computed by the sigmoid function, $$h_j=1/(1+\exp-(w_{j0}+\Sigma w_{ij}I_i)),$$

where, $w_{j0}$ is the bias weight

The back propagation algorithm was used to minimize the differences between the computed output and the desired output. Ten thousand cycles (epochs) of iterations are performed. Subsequently, the best epoch with minimum error was identified. At this point the network produces approximate target values for a given input in the training set.

A network was trained optimally for each attribute. Thus five networks were prepared. The schematic diagram (FIG. 1) shows the procedure adopted. The number of neurons in the input layer was equal to the number of input data points for each attribute (for example 20 neurons for 20 numerical input vectors of the amino acid composition attribute). The optimal number of neurons in the hidden layer was determined through experimentation for minimizing the error at the best epoch for each network individually. An upper limit for the total number of weight connections was set to half of the total number of input vectors to avoid over fitting as suggested previously (Andrea et al).

Computer programs to compute individual compositional attributes were written in C and executed on a PC under Red Hat Linux ver 7.3 or 8.0. The network was trained on the training set, checks error and optimizes using the validate set through back propagation. The validate set was different from the training set. Since, the number of well annotated adhesins were not many, we used the 'validate set' itself as test set for preliminary evaluation of the performance and to obtain the fraction of correlation to compute the weighted average probability ($P_{ad}$ value) described in the next section. The training set had 367 adhesins and 580 non-adhesins. The validate set had 102 adhesins and 123 non-adhesins. The adhesins were qualified with a digit '1' and the non-adhesins were qualified with a digit '0'.

During predictions, the network is fed with new data from the sequences that were not part of training set. Each network assigns a probability value of being an adhesin to a given sequence. The final probability is computed as described in the next section.

Probability of being an Adhesin, the $P_{ad}$ Value

Query proteins are processed modularly through network trained for each attribute. Thus, five probability outputs are obtained. Final prediction was computed using the following expression which is a weighted linear sum of the probabilities from five modules:

$$P_{ad}=\frac{(P_A*fc_A+P_C*fc_C+P_D*fc_D+P_H*fc_H+P_M*fc_M)}{(fc_A+fc_C+fc_D+fc_H+fc_M)}$$

$P_i$=Probability from i module, $fc_i$=fraction of correlation of i module of the trained Neural Network, Where i=A (Amino acid frequencies), C (Charge composition), D (Dipeptide frequencies), H (Hydrophobic composition), or M (Multiplet frequencies).

The fraction of correlation $fc_i$ represents the fraction of total entries that were correctly predicted. ($P_{i,adhesin}>0.5$ and $P_{i,non-adhesin}<0.5$) by the trained network on the test set used in preliminary evaluation (Charles Anderson).

Neural Network

A feed forward error back propagation Neural Network was used. The program was downloaded from the web site with permission from the author, Charles W. Anderson, Department of Computer Science, Colorado State University, Fort Collins, Colo. 80523, anderson@cs.colostate.edu Statistical Analysis All statistical procedures were carried out using Microsoft Excel (Microsoft Corporation Inc. USA).

Sequence Analysis

Homology analysis was carried out using CLUSTAL W (Thompson et al 1994), BLAST (Altschul et al 1990), CDD (conserved domain database) search (Marchler-Bauer et al 2002).

The whole genome sequences of microbial pathogens present new opportunities for the development of clinical applications such as diagnostics and vaccines. The present invention provides new leads for the development of candidate genes, and their encoded proteins in their functional relevance to preventive therapeutics.

The protein sequences of both the classes, i.e. adhesin and non-adhesin, were downloaded from the existing database (National Centre for Biotechnology Information (NCBI), USA). A total of 105 compositional properties under the five sequence attributes namely, amino acid composition, multiplet composition, dipeptide composition, charge composition and hydrophobic composition were computed by computer programs written in C language. The attributes were computed for all the proteins in both the databases. The sequence-based attributes were then used to train Artificial Neural Network for each of the protein attributes. Adhesins were qualified, by the digit '1' and non-adhesins were qualified by the digit '0'. Finally each trained Artificial Neural Network was used to identify potential adhesins which can be envisaged to be useful for the development of preventive therapeutics against pathogenic infections. Accordingly, the invention provides a computational method for identifying adhesin and adhesin-like proteins of therapeutic potential, which comprises:

1. preparing two comprehensive data-sets of adhesin and non-adhesin proteins from publicly available information on protein sequences,
2. calculating computationally the sequence based attributes of the protein sequences in the publicly available protein datasets using specially developed Software for Prediction of Adhesins and Adhesin-like proteins using Neural Networks (SPAAN),
3. training the Artificial Neural Network (ANN) for the selected attributes,
4. assigning probability value suitable for an adhesin, "$P_{ad}$" to the query protein and identifying adhesin like property in the query proteins with the help of trained Artificial Neural Network implemented in SPAAN,
5. validating computationally the protein sequences as therapeutic potentials by comparing with the known protein sequences that are biochemically characterized in the pathogen genome.

In an embodiment of the invention the protein sequence data may be taken from an organism, specifically but not limited to organisms such as *Escherichia coli, Haemophilus influenzae, Helicobacter pylori, Mycoplasma pneumoniae, Mycobacterium tuberculosis, Rickettsiae prowazekii, Porphyromonas gingivalis, Shigella flexneri, Streptococcus mutans, Streptococcus pneumoniae, Neisseria meningitides, Streptococcus pyogenes, Treponema pallidum,* Severe Acute Respiratory Syndrome associated coronavirus.

In another embodiment to the present invention different sequence-based attributes used for identification of proteins of therapeutic potential, comprise amino acid composition, charge composition, hydrophobicity composition, multiplets frequencies, and dipeptide frequencies.

In an embodiment, the non-homologous adhesin protein sequence may be compared with that of known sequences of therapeutic applications in the selected pathogens.

In an embodiment of the invention, the sequences of adhesin or adhesin like proteins comprise sequences of sequences IDs listed in Tables 5 and.6 identified by the method of invention.

Another embodiment of the invention the computer system comprises a central processing unit, executing SPAAN program, giving probabilities based on different attributes using Artificial Neural Network and in built other programs of assessing attributes, all stored in a memory device accessed by CPU, a display on which the central processing unit displays the screens of the above mentioned programs in response to user inputs; and a user interface device.

In One embodiment of the present invention, the particulars of the organisms such as their name, strain, accession number in NCBI database and other details are given in Table 2:

The invention is further explained with the help of the following examples, which are given by illustration and should be construed to limit the scope of the present invention in any manner.

EXAMPLE 1

Operating SPAAN:

The purpose of the program is to computationally calculate various sequence-based attributes of the protein sequences.

The program works as follows:

The internet downloaded FASTA format files obtained from http://www.ncbi.nlm.nih.gov were saved by the name <organism_name>.faa are converted in the standard format by C program and passed as input to another set of C programs which computes the 5 different attributes of protein sequences (a total of 105 compositional properties in all 5 modules).

The computed properties were fed as input to the 5 different Neural Networks. Each trained network assigns a probability value of being an adhesin for a query protein. The final probability ($P_{ad}$) was calculated as weighted average of these five individual probabilities. The weights were determined from a correlation value of correct; prediction during test runs of each of the five modules.

Input/Output format:

Downloaded Files and their format:

<organism name>.faa: file which stores the annotation and the protein sequence.

Input file Format: FASTA

">gi.vertline."<annotation>

For example,

>gi.vertline.2314605.vertline.gb.vertline.AAD08472.vertline.histidine and glutamine-rich protein

MAHHEQQQQQQANSQHHHHHHHAHHHHYYGGEHHHHHNAQQHAEQQAEQQ

AQQQQQQQAHQQQQQKAQQQNQQY

>gi.vertline.3261822.vertline.gnl.vertline.PID.vertline.e328405 PE_PGRS

MIGDGANGGPGQPGGPGGLLYGNGGHGGAGAAGQDRGAGNSAGLIGNGGA

GGAGGNGGIGGAGAPGGLGGDGGKGGFADEFTGGFAQGGRGGFGGNGNTG

ASGGMGGAGGAGGAGGAGGLLIGDGGAGGAGGIGGAGGVGGGGGAGGTGG

GGVASAFGGGNAFGGRGDGGDGGDGGTGGAGGARGAGGAGGAGGWLSGH

SGAHGAMGSGGEGGAGGGGARGEAGAGGGTSTGTNPGKAGAPGTQGDSG

DPGPPG

>gi.vertline. . . . .

TABLE 1

| | Output file format given by SPAAN <organism_name>.out | | | | | | |
|---|---|---|---|---|---|---|---|
| SN | $P_A$ | $P_C$ | $P_D$ | $P_H$ | $P_M$ | $P_{ad}$-value | Protein Name |
| 1 | 0.05683 | 0.290803 | 0.441338 | 0.50304 | 0.029503 | 0.260485 | >gi.vertline.32454344.vertline.gb.vertline.AAP82966.1.vertline.orf1a polyprotein [SARS coronavirus Hong Kong ZY-2003] |
| 2 | 0.639235 | 0.166721 | 0.054583 | 0.935385 | 0.453498 | 0.462452 | >gi.vertline.32454345.vertline.gb.vertline.AAP82967.1.vertline.orf1ab polyprotein [SARS coronavirus Hong Kong ZY-2003] |
| 3 | 0.651111 | 0.911504 | 0.438696 | 0.543944 | 0.924044 | 0.690247 | >gi.vertline.32454346.vertline.gb.vertline.AAP82968.1.vertline.spike glycoprotein [SARS coronavirus Hong Kong ZY-2003] |

TABLE 1-continued

Output file format given by SPAAN
<organism_name>.out

| SN | $P_A$ | $P_C$ | $P_D$ | $P_H$ | $P_M$ | $P_{ad}$-value | Protein Name |
|---|---|---|---|---|---|---|---|
| 4 | 0.464324 | 0.655003 | 0.179503 | 0.008700 | 0.241573 | 0.300970 | >gi.vertline.32454347.vertline.gb.vertline.AAP82969.1.vertline.Orf3a [SARS coronavirus Hong Kong ZY-2003] |

Where $P_A$, $P_C$, $P_D$, $P_H$, $P_M$ are the outputs of the five Neural Networks.

EXAMPLE 2

Organisms and Sequence Numbers

TABLE 2

Organism Name, Accession number, Number of base pairs, Date of release and Total number of proteins analyzed

| Organism Name | Accession Number | Number of base pairs | Date of release | Total no. of proteins |
|---|---|---|---|---|
| E. coli O157 H7 | NC_002695 | 5498450 | 7 Mar. 2001 | 5361 |
| H. influenzae Rd | NC_000907 | 1830138 | 30 Sep. 1996 | 1709 |
| H. pylori J99 | NC_000921 | 1643831 | 10 Sep. 2001 | 1491 |
| M. pneumoniae | NC_000912 | 816394 | 2 Apr. 2001 | 689 |
| M. tuberculosis H37Rv | NC_000962 | 4411529 | 7 Sep. 2001 | 3927 |
| R. prowazekii strain Madrid E | NC_000963 | 1111523 | 10 Sep. 2001 | 835 |
| P. gingivalis W83 | NC_002950 | 2343476 | 9 Sep. 2003 | 1909 |
| S. flexneri 2a str. 2457T | NC_004741 | 4599354 | 23 Apr. 2003 | 4072 |
| S. mutans UA159 | NC_004350 | 2030921 | 25 Oct. 2002 | 1960 |
| S. pneumoniae R6 | NC_003098 | 2038615 | 6 Sep. 2001 | 2043 |
| N. meningitidis serogroup A strain Z2491 | NC_003116 | 2184406 | 27 Sep. 2001 | 2065 |
| S. pyogenes MGAS8232 | NC_003485 | 1895017 | Jan. 31, 2002 | 1845 |
| T. pallidum subsp. pallidum str. Nichols | NC_000919 | 1138011 | 7 Sep. 2001 | 1036 |
| Severe Acute Respiratory Syndrome (SARS) associated coronavirus Frankfurt 1 | AY291315 | 29727 | 11 JUN. 2003 | 14 |
| SARS coronavirus HSR1 | AY323977 | 29751 | 15 OCT. 2003 | 14 |
| SARS coronavirus ZJ01 | AY297028 | 29715 | 19 MAY 2003 | 3 |
| SARS coronavirus TW1 | AY291451 | 29729 | 14 MAY 2003 | 11 |
| SARS coronavirus CUHK-Su10 | AY282752 | 29736 | 07 MAY 2003 | 4 |
| SARS coronavirus Urbani | AY278741 | 29727 | 12 AUG. 2003 | 12 |
| SARS coronavirus | NC_004718 | 29751 | 9 Sep. 2003 | 29 |
| SARS coronavirus Tor2 | AY274119 | 29751 | 16 MAY 2003 | 15 |
| SARS coronavirus GD01 | AY278489 | 29757 | 18 AUG. 2003 | 12 |
| SARS coronavirus CUHK-W1 | AY278554 | 29736 | 31 JUL. 2003 | 11 |
| SARS coronavirus BJ01 | AY278488 | 29725 | 01 MAY 2003 | 11 |

EXAMPLE 3

The multi-layered feed forward Neural Network architecture implemented in SPAAN (FIG. 1). A given protein sequence in FASTA format is first processed through the 5 modules A, C, D, H, and M to quantify the five types of compositional attributes. A: Amino acid composition, C: Charge composition, D: dipeptide composition of the 20 dipeptides (NG, RE, TN, NT, GT, TT, DE, ER, RR, RK, RI, AT, TS, IV, SG, GS, TG, GN, VI, HR), H: Hydrophobic composition, M: Amino acid frequencies as Multiplets. The sequence shown is part of the FimH precursor (gi 5524634) of E. coli. Subsequently, these numerical data are input to the input neuron layer. The directions of arrows show data flow. The number of neurons chosen in the input layer was equal to the number of the numerical input vectors of each module. The network was optimally trained through minimization of error of detection based on validate set through back propagation. The details are described in the methods. Each network module assigns a probability value of the protein being an adhesin based on the corresponding attribute. The final probability of a protein sequence being an adhesin is the $P_{ad}$ value a weighted average of the individual probabilities and the associated fraction of correlation which is a measure of the strength of the prediction.

EXAMPLE 4

Performance of SPAAN assessed using a test set of 37 adhesins and 37 non-adhesins that were not part of the training set. Matthew's correlation coefficient (Mcc, plotted on Y-axis) for all the proteins with $P_{ad}$ values above a given threshold (plotted on X-axis) (FIG. 2). The Matthew's correlation is defined as:

$$Mcc = \frac{(TP*TN) - (FP*FN)}{\sqrt{(TN+FN)(TN+FP)(TP+FN)(TP+FP)}}$$

Where TP=True Positives, TN=True Negatives, FP=False Positives, FN=False Negatives.

Here TPs are adhesins, TNs are non-adhesins. In general, adhesins have high $P_{ad}$ value, whereas non-adhesins have low $P_{ad}$ value. Thus known adhesins with $P_{ad}$ value above a given threshold are true positives whereas known non-adhesins with $P_{ad}$ value below the given threshold are true negatives. The sensitivity, Sn is given by $$\left(\frac{TP}{TP+FN}\right)$$

and specificity, Sp is given by $$\left(\frac{TP}{TP+FP}\right).$$

False negatives are those cases, wherein a known adhesin had $P_{ad}$ value lower than the chosen threshold. Similarly, a known non-adhesin with a $P_{ad}$ value higher than the chosen threshold was taken as false positive. A theoretical polynomial curve of second order (dashed line) was fitted to the observed curve (smooth line) with a Karl-Pearson correlation coefficient $R^2=0.9799$. The maximum point of the theoretical curve (where first derivative vanishes and second derivative is negative) was chosen as reference (vertical dotted line) to identify the maximum Mcc=0.94 on the observed curve (shown by arrow). The corresponding $P_{ad}$ value threshold was 0.51. At this $P_{ad}$ value threshold, Sn and Sp were 0.89 and 1.0 respectively. Note that the Mcc does not drop down to the x-axis because the highest $P_{ad}$ value attained by adhesins was 0.939 in comparison to the theoretical attainable limit of 1.0.

EXAMPLE 5

Assessment of SPAAN on well known adhesins from various bacterial pathogens.

TABLE 3

Prediction of well characterized adhesins from various bacterial pathogens using SPAAN.

| Species | Disease caused | Adhesin[a] | Host ligand | $P_{ad}$ value[b] (Range) |
|---|---|---|---|---|
| E. coli | Diarrhoea | PapG (27) | α-D-gal(1-4) β-D-Gal-containing receptors | 0.84-0.76 |
| | | SfaS (5) | alpha-sialyl-beta-2,3-b-galactose | 0.94-0.94 |
| | | FimH (63) | D-mannosides | 0.96-0.23[c] |
| | | Intimin (12) | tyrosine-phosphorylated form of host cell receptor Hp90 | 0.95-0.78 |
| | | PrsG (5) | Gal(alpha1-4)Gal | 0.86-0.85 |
| Nontypeable H. influenza | Influenza | HMW1, HMW2 | Human epithelial cells | 0.97 |
| | | Hia (8) | human conjuctival cells | 0.93-0.90 |
| H. influenzae | bacterial meningitis[d] | HifE (18) | Sialylyganglioside-GM1 | 0.85-0.73 |
| K. pneumoniae | Pneumonia | MrkD | type V collagen | 0.82 |
| B. pertussis | Whooping cough | FHA | Sulphated sugars on cell-surface glycoconjugates | 0.85 |
| | | Pertactin | Integrins | 0.43 |
| Y. enterocolitica | Enterocolitis | YadA (5) | $\beta_1$ integrins | 0.88-0.79 |
| S. mutans | Dental Caries | SpaP (2) | Salivary glycoprotein | 0.88, 0.87 |
| | | PAc | Salivary glycoprotein | 0.88 |
| Streptococcus gordonii | Oral cavity | SspA (2) | Salivary glycoprotein | 0.85, 0.84 |
| | | CshA | Fibronectin | 0.78 |
| | | CshB | Fibronectin | 0.63 |
| | | ScaA | Co-aggregation | 0.71 |
| | | SspB (2) | Salivary glycoprotein | 0.85, 0.84 |
| Streptococcus sobrinus | Tooth decay | SpaA | Salivary glycoprotein | 0.89 |
| | | PAg (2) | Salivary glycoprotein | 0.89, 0.73 |
| Streptococcus pyogenes | Scarlet Fever | Protein F | Fibronectin | 0.49 |
| Streptococcus pneumoniae | Bacterial Pneumonia | PsaA (5) | Human nasopharyngeal cells | 0.82-0.78 |
| | | CbpA[e]/ SpsA/ PbcA/PspC | phosphorylcholine of the teichoic acid. | 0.81-0.49 |
| Streptococcus parasanguis | Valve endocarditis | FimA | Salivary glycoprotein fibrin | 0.76 |
| Streptococcus sanguis | Tooth Decay | SsaB | Salivary glycoprotein | 0.71 |
| Enterococcus | Empyma in | EfaA | Unknown | 0.83 |

TABLE 3-continued

Prediction of well characterized adhesins from various bacterial pathogens using SPAAN.

| Species | Disease caused | Adhesin[a] | Host ligand | $P_{ad}$ value[b] (Range) |
|---|---|---|---|---|
| faecalis | patients with liver disease | | | |
| Staphylococcus aureus | Food Poisoning | FnbA FnbB (3) | Fibronectin Fibronectin | 0.8 0.78, 0.77, 0.69 |
| Helicobacter pylori | Peptic Ulcers | BabA (17) | difucosylated Lewis[b] blood group antigen | 0.87-0.68 |

[a]The number of sequences from different strains and homologs from related species analyzed are shown in parantheses.
[b]Rounded off to the second decimal.
[c]Out of 63 FimH proteins, 54 were from *E. coli*, 6 from *Shigella flexineri*, 2 from *Salmonella enterica* and 1 was from *Salmonella typhimurium*. Except 2 FimH proteins, the rest had $P_{ad} \geq 0.51$. The 2 exceptions (gi numbers: 5524636, 1778448) were from *E. coli*. The gi: 5524636 protein is annotated as a FimH precursor but is much shorter (129 amino acids) than other members of the family. The gi: 1778448 protein is a *S. typhimurium* homolog in *E. coli*.
[d]Other ailments include pneumonia, epiglottitis, osteomyelitis, septic arthritis and sepsis in infants and older children.
[e]The adhesin CbpA is also known by alternative names SpsA, PbcA and PspC. A total of seven sequences were analyzed. Except 1 PspC sequence, the rest all had $P_{ad} \geq 0.51$.

EXAMPLE 6

Ability of SPAAN to discriminate adhesins from non-adhesins at $P_{ad} \geq 0.51$ (FIG. 3-*a*).

EXAMPLE 7

Figure 3C:
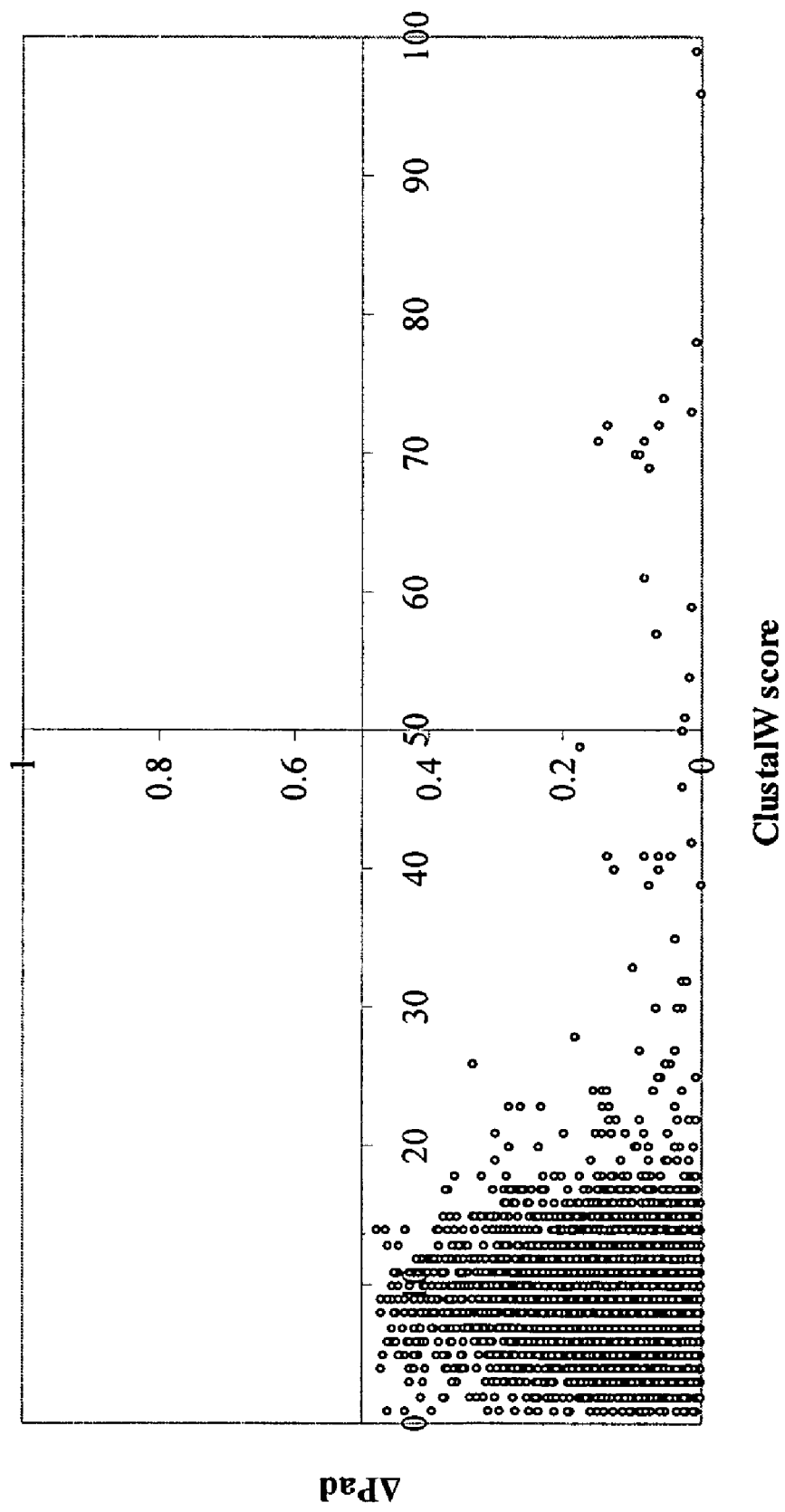

The non-homology character of SPAAN assesses in both adhesins and non-adhesins (FIGS. 3*b* and 3*c*).

FIG. 3(*a-c*). SPAAN is non-homology based software. A total of 130 adhesins and 130 non-adhesins were analyzed to assess whether the predictive power of SPAAN could be influenced by the sequence relationships. (a) Histogram plots of the number of proteins in the various $P_{ad}$ value ranges are shown. Shaded bars represent adhesins whereas open bars represent non-adhesins. Note the SPAAN's ability to segregate adhesins and non-adhesins into two distinct cohesive groups. (b) Pairwise sequence relationships among the adhesins were determined using CLUSTAL W and plotted on X-axis. Higher scores indicate similar pairs. The corresponding differences in $P_{ad}$ values in the same protein pair was plotted on the Y-axis. Each point in the diagram represents a pair. Arrow points to protein pairs of the FimH family with high $\Delta P_{ad}$ values in spite of high similarity. Since one of the FimH proteins (gi: 5524636) had very low $P_{ad}$ value all pairs with this false negative protein show high $\Delta P_{ad}$ values. The protein (gi: 5524636) is of much shorter length compared with other members of the same family. (c) plot for non-adhesins. Data are plotted in the 4 quadrant format for clear inspection. Note that among protein pairs with CLUSTAL W score <20 the majority (82% in adhesins and 86% in non-adhesins) have $\Delta P_{ad} < 0.2$. These data support the non-homology character of SPAAN.

EXAMPLE 8

Genomescan of pathogens by SPAAN identifies well known adhesins and new adhesins and adhesin-like proteins

TABLE 4

Analysis of predictions made by SPAAN on genome scans of a few selected pathogenic organisms[a]

| Protein Class | Species | | |
|---|---|---|---|
| | *Escherichia coli* O157:H7 | *Mycobacterium tuberculosis* H37Rv | SARS associated corona virus (11 strains) |
| Total number of proteins with $P_{ad} \geq 0.51$ | 575 | 435 | 5 |
| Known adhesins | 17[b] | — | — |
| Putative proteins with adhesin like characteristics | 92[c] | 105[j] | — |
| Hypothetical proteins with adhesin-like characteristics | 22[d] | — | — |
| Proteins likely to be extracytoplasmic or located at surface | 190[e] | 191[k] | 5[m] |
| Phage proteins | 30[f] | — | — |
| Others | 13[g] | 6[l] | — |
| Hypothetical proteins | 157[h] | 86[h] | — |
| Wrong predictions | 54[i] | 47[i] | — |

[a]SPAAN has general applicability. The three pathogens chosen here are those in which intense investigations are being conducted presently. *M. tuberculosis* is of special importance to developing countries.
[b]Fimbrial adhesins, AidA-I, gamma intimin, curlin, translocated intimin receptor, putative adhesin and transport, Iha, prepilin peptidase dependent protein C.
[c]These proteins have been annotated as proteins with a putative function. These sequences were analyzed using CDD (Conserved domain database, NCBI) and BLAST searches. Adhesin like domains were found in these proteins.
[d]These proteins have been annotated as 'hypothetical'. These sequences were analyzed using CDD and BLAST searches. Adhesin like domains were found in these proteins.
[e]These proteins are outer membrane, extracellular, transport, surface, exported, flagellar, periplasmic lipoprotein, and proteins annotated as 'hypothetical' but found to have similar functions listed here using BLAST and CDD searches.
[f]The phage proteins were of the following functional roles - tail fiber, head decoration, DNA injection, tail, major capsid, host specificity, endolysin.

TABLE 4-continued

Analysis of predictions made by SPAAN on genome scans of a few selected pathogenic organisms[a]

| Protein Class | Species | | |
|---|---|---|---|
| | *Escherichia coli* O157:H7 | *Mycobacterium tuberculosis* H37Rv | SARS associated corona virus (11 strains) |

[g]Proteins predicted by SPAAN but not readily classifiable into the classes listed here have been collectively grouped as 'Others'. However, some of these proteins are known to participate in host-pathogen interactions. The annotated functional roles are typeIII secretion, antibiotic resistance, heat shock, acid shock, structural, tellurium resistance, terminase, Hcp-like, Sec-independent translocase, uncharacterized nucleoprotein, HicB-like.
[h]These proteins have been annotated as hypothetical. Re-analyses of these proteins using BLAST and CDD failed identify any function for these proteins.
[i]These proteins have been annotated with functional roles that are very likely to occur within the cell. Hence these proteins may have remote possibility of functioning as adhesins or adhesin-like proteins. Therefore this set of proteins have been incorrectly predicted as adhesins or adhesin-like by SPAAN.
[j]These proteins are PE_PGRS, PE proteins. Several reports (for example Brennan et al.) indicate that PE_PGRS proteins may be localized to cell surface and aid in host-pathogen interaction.
[k]Lipoproteins (lpp, lpq, lpr), PPE, outer membrane, surface, transport, secreted, periplasmic, extracellular, ESAT-6, peptidoglycan binding, exported, mpt (with extracellular domains), and proteins annotated as 'hypothetical' but found to have similar functions listed here using BLAST and CDD searches.
[l]These proteins were of the following functions - glutaredoxin-like thiol-transferase, putative involvement in molybdate uptake, ATP synthase chain, sulphotransferases, *S. erythraea* rhodanese-like protein M29612|SERCYSA_5, unknown function.
[m]These proteins were the spike glycoprotein with antigenic properties, and nsp2, nsp5, nsp6 and nsp7.

TABLE 5

New putative adhesins predicted by SPAAN in the genomes listed in table 2 -
(Total number = 279)

| Protein GI Number | Gene ID | Protein name |
|---|---|---|
| | | *Escherichia coli* O157:H7 |
| 13360742 | 912619 | hemagglutinin/hemolysin-related protein |
| 13362986 | 914770 | putative ATP-binding component of a transport system |
| 13361114 | 913228 | putative tail fiber protein |
| 13364757 | 913676 | minor fimbrial subunit/D-mannose specific adhesin |
| 13362687 | 915687 | putative fimbrial-like protein |
| 13360856 | 912599 | AidA-I adhesin-like protein |
| 13364140 | 915374 | putative fimbrial protein |
| 13359793 | 914435 | putative invasin |
| 13364768 | 913650 | putative invasin |
| 13364034 | 915471 | Gamma intimin |
| 13362703 | 915668 | putative DNA transfer protein precursor |
| 13364141 | 915376 | putative fimbrial protein |
| 13359819 | 914463 | AidA-I adhesin-like protein |
| 13360480 | 917768 | putative fimbrial-like protein |
| 13362692 | 915681 | putative fimbrial-like protein |
| 13362585 | 916824 | putative ATP-binding component of a transport system |
| 13359881 | 914526 | putative flagellin structural protein |
| 13361579 | 917311 | putative type 1 fimbrial protein precursor |
| 13360880 | 913991 | curlin major subunit CsgA |
| 13364036 | 915465 | translocated intimin receptor Tir |
| 13360740 | 912615 | putative major pilin protein |
| 13361582 | 917317 | putative ATP-binding component of a transport system and adhesin protein |
| 13364754 | 913683 | export and assembly outer membrane protein of type 1 fimbriae |
| 13360484 | 917767 | homolog of *Salmonella* FimH protein |
| 13364751 | 913688 | major type 1 subunit fimbrin |
| 13359597 | 913742 | putative fimbrial protein |
| 13362550 | 916787 | putative ATP-binding component of a transport system |
| 13359595 | 913739 | putative fimbrial protein |
| 13359599 | 913748 | probable outer membrane porin protein involved in fimbrial assembly |
| 13363900 | 915704 | putative fimbrial protein precursor |
| 13361575 | 917307 | putative fimbrial-like protein |
| 13364756 | 913678 | fimbrial morphology |
| 13363496 | 916142 | truncated putative fimbrial protein |
| 13359601 | 913761 | putative fimbrial-like protein |
| 13364145 | 915368 | putative type 1 fimbrial protein |
| 13363902 | 915708 | putative outer membrane usher protein precursor |
| 13361576 | 917309 | putative outer membrane protein |
| 13361013 | 913353 | putative major tail subunit |
| 13364755 | 913682 | fimbrial morphology |

TABLE 5-continued

New putative adhesins predicted by SPAAN in the genomes listed in table 2 -
(Total number = 279)

| Protein GI Number | Gene ID | Protein name |
|---|---|---|
| 13360738 | 912793 | putative outer membrane usher protein |
| 13363928 | 915608 | alpha-amylase |
| 13363495 | 916144 | putative outer membrane protein |
| 13362383 | 916617 | putative type-1 fimbrial protein |
| 13364373 | 914972 | outer membrane vitamin B12 receptor protein BtuB |
| 13360879 | 912479 | minor curlin subunit precursor CsgB |
| 13360739 | 912756 | putative chaperone protein |
| 13361574 | 917314 | putative fimbrial-like protein |
| 13361127 | 913212 | outer membrane protease precursor |
| 13363210 | 916442 | putative lipoprotein |
| 13361104 | 913238 | major tail protein |
| 13361709 | 917446 | putative major tail subunit |
| 13359725 | 914366 | outer membrane pore protein PhoE |
| 13360875 | 913765 | curli production assembly/transport component CsgF |
| 13362170 | 913927 | putative outer membrane protein |
| 13361473 | 917203 | putative BigB-like protein |
| 13364025 | 915286 | EspF protein |
| 13360081 | 916982 | outer membrane receptor for ferric enterobactin (enterochelin) and colicins B and D |
| 13362977 | 914779 | hypothetical lipoprotein |
| 13360351 | 917632 | outer membrane protein X |
| 13360696 | 914208 | putative outer membrane precursor |
| 13361456 | 917206 | putative outer membrane protein |
| 13361626 | 917374 | putative outer host membrane protein precursor |
| 13361698 | 917449 | putative outer membrane protein |
| 13362186 | 913421 | putative outer membrane protein precursor |
| 13362697 | 915676 | long-chain fatty acid transport protein FadL |
| 13360918 | 914188 | flagellar hook protein FlgE |
| 13360737 | 912506 | putative outer membrane protein |
| 13360342 | 917629 | putative outer membrane receptor for iron transport |
| 13363396 | 916248 | outer membrane channel TolC |
| 13361958 | 912705 | putative scaffolding protein in the formation of a murein-synthesizing holoenzyme |
| 13359921 | 914566 | nucleoside-specific channel-forming protein TSX |
| 13360944 | 913890 | outer membrane receptor for ferric iron uptake |
| 13359998 | 914644 | putative outer membrane transport protein |
| 13363390 | 916251 | putative ferrichrome iron receptor precursor |
| 13364227 | 915153 | outer membrane phospholipase A |
| 13361982 | 912846 | putative outer membrane protein |
| 13360129 | 917032 | a minor lipoprotein |
| 13361817 | 912692 | putative outer membrane protein |
| 13360233 | 917507 | membrane spanning protein TolA |
| 13362837 | 915218 | putative outer membrane lipoprotein |
| 13362328 | 912985 | putative colanic acid biosynthesis glycosyl transferase |
| *Haemophilus influenzae* Rd | | |
| 16272254 | 949521 | prepilin peptidase-dependent protein D |
| 16272928 | 950762 | immunoglobin A1 protease |
| 16272129 | 951072 | lipoprotein |
| 16273251 | 950616 | hemoglobin-binding protein |
| 30995429 | 950130 | opacity protein |
| 16272854 | 949634 | protective surface antigen D15 |
| 16272283 | 950648 | opacity associated protein |
| 16272604 | 949701 | hemoglobin-binding protein |
| *Helicobacter pylori* J99 | | |
| 4155101 | 889167 | putative vacuolating cytotoxin (VacA) paralog |
| 4154798 | 890022 | putative vacuolating cytotoxin (VacA) paralog |
| 4155426 | 890036 | putative vacuolating cytotoxin (VacA) paralog |
| 4155390 | 890075 | vacuolating cytotoxin |
| 4155400 | 890058 | outer membrane protein - adhesin |
| 4155681 | 889718 | putative Outer membrane protein |
| 4155420 | 890042 | Outer membrane protein/porin |
| 4155775 | 889799 | outer membrane protein - adhesin |
| 4155419 | 890044 | Outer membrane protein/porin |
| 4154526 | 889066 | putative Outer membrane protein |
| 4154724 | 889419 | putative Outer membrane protein |
| 4155862 | 890404 | putative Outer membrane protein |
| 4156048 | 889958 | putative IRON(III) DICITRATE TRANSPORT PROTEIN |
| 4154510 | 889297 | putative Outer membrane protein |
| 4155432 | 889515 | putative outer membrane protein |
| 4155623 | 889671 | putative Outer membrane protein |

TABLE 5-continued

New putative adhesins predicted by SPAAN in the genomes listed in table 2 -
(Total number = 279)

| Protein GI Number | Gene ID | Protein name |
|---|---|---|
| 4155700 | 889739 | putative Outer membrane function |
| 4154740 | 889426 | Outer membrane protein/porin |
| 4155692 | 889743 | putative Outer membrane protein |
| 4155594 | 889648 | putative outer membrane protein |
| 4155680 | 889719 | putative Outer membrane protein |
| 4155217 | 890243 | putative Outer membrane protein |
| 4155958 | 889905 | putative Outer membrane protein |
| 4155201 | 890259 | putative Outer membrane protein |
| 4155013 | 889232 | cag island protein |
| 4154974 | 889032 | putative Outer membrane protein |
| 4155214 | 890244 | putative Outer membrane protein |
| 4154973 | 889042 | Outer membrane protein |
| 4155344 | 890115 | putative Outer membrane protein |
| 4155099 | 889160 | FLAGELLIN A |
| 4155023 | 888978 | cag island protein |
| 4155035 | 889201 | cag island protein, CYTOTOXICITY ASSOCIATED IMMUNODOMINANT ANTIGEN |
| 4155289 | 890164 | NEURAMINYLLACTOSE-BINDING HEMAGGLUTININ PRECURSOR |

*Mycoplasma pneumoniae*

| | | |
|---|---|---|
| 13507881 | 877207 | involved in cytadherence |
| 13507880 | 877268 | ADP1_MYCPN adhesin P1 |
| 13508228 | 877211 | species specific lipoprotein |
| 13508181 | 877124 | species specific lipoprotein |
| 13508179 | 877071 | Mollicute specific lipoprotein, MG307 homolog, from *M. genitalium* |
| 13508178 | 877118 | Mollicute specific lipoprotein, MG307 homolog, from *M. genitalium*, |
| 13508176 | 876797 | Mollicute specific lipoprotein, MG307 homolog, from *M. genitalium* |
| 13508175 | 876848 | Mollicute specific lipoprotein, MG307 homolog, from *M. genitalium* |
| 13508106 | 876953 | involved in cytadherence |
| 13508350 | 877112 | similar to phosphate binding protein Psts |

*Mycobacterium tuberculosis* H37 Rv

| | | |
|---|---|---|
| 15607496 | 886491 | PPE |
| 15607445 | 886592 | PPE |
| 15610644 | 888270 | PE_PGRS |
| 15608588 | 886605 | PE_PGRS |
| 15609627 | 887941 | PE_PGRS |
| 15610643 | 888256 | PE_PGRS |
| 15607718 | 887725 | PE_PGRS |
| 15609054 | 885362 | PPE |
| 15610486 | 888113 | PPE |
| 15610483 | 888120 | PPE |
| 15610479 | 888033 | PPE |
| 15609771 | 888573 | PE_PGRS |
| 15610648 | 888306 | PE_PGRS |
| 15610481 | 888114 | PE_PGRS |
| 15608117 | 885264 | PE_PGRS |
| 15607973 | 885391 | PE_PGRS |
| 15608231 | 885258 | PE_PGRS |
| 15608906 | 885429 | PE_PGRS |
| 15608891 | 885544 | PPE |
| 15609990 | 888171 | PE_PGRS |
| 15609055 | 885506 | PPE |
| 15608227 | 887094 | PE_PGRS |
| 15610524 | 888151 | PE_PGRS |
| 15609490 | 886003 | PPE |
| 15607886 | 888664 | PE_PGRS |
| 15609624 | 887909 | PE_PGRS |
| 15607420 | 886621 | PE_PGRS |
| 15608897 | 885325 | PE_PGRS(wag22) |
| 15608590 | 886595 | PE_PGRS |
| 15609728 | 887992 | PE_PGRS |
| 15608012 | 885742 | PE_PGRS |
| 15608534 | 886745 | PE_PGRS |
| 15608940 | 885730 | PE_PGRS |
| 15607887 | 888662 | PE_PGRS |
| 15609235 | 888312 | PE_PGRS |
| 15610694 | 887822 | PPE |
| 15609533 | 885517 | PE_PGRS |
| 15610480 | | PE_PGRS |

TABLE 5-continued

New putative adhesins predicted by SPAAN in the genomes listed in table 2 - 
(Total number = 279)

| Protein GI Number | Gene ID | Protein name |
|---|---|---|
| \multicolumn{3}{c}{*Rickettsia prowazekii* strain Madrid E} |
| 15604316 | 883411 | CELL SURFACE ANTIGEN (sca3) |
| 15604546 | 883694 | CELL SURFACE ANTIGEN (sca5) |
| \multicolumn{3}{c}{*Porphyromonas gingivalis* W83} |
| 34541453 | 2551934 | hemagglutinin protein HagA |
| 34540040 | 2551409 | lipoprotein, putative |
| 34540364 | 2552375 | extracellular protease, putative |
| 34541613 | 2552074 | hemagglutinin protein HagE |
| 34540183 | 2551891 | internalin-related protein |
| \multicolumn{3}{c}{*Shigella flexneri* 2a str. 2457T} |
| 30065424 | 1080663 | minor fimbrial subunit, D-mannose specific adhesin |
| 30062726 | 1077662 | putative adhesion and penetration protein |
| 30063758 | 1078834 | putative fimbrial-like protein |
| 30065431 | 1080671 | major type 1 subunit fimbrin (pilin) |
| 30063366 | 1078379 | flagellar protein FliD |
| 30064308 | 1079668 | outer membrane fluffing protein |
| 30062613 | 1077555 | flagellar hook protein FlgE |
| 30061954 | 1076843 | conserved hypothetical lipoprotein |
| 30065173 | 1080393 | putative lipase |
| 30065425 | 1080664 | minor fimbrial subunit, precursor polypeptide |
| 30064485 | 1079637 | putative fimbrial protein |
| 30062615 | 1077558 | flagellar basal body L-ring protein FlgH |
| 30064307 | 1079452 | outer membrane fluffing protein |
| 30065601 | 1080859 | putative glycoprotein/receptor |
| 30062118 | 1077025 | putative fimbrial-like protein |
| 30064099 | 1079223 | lipoprotein |
| 30062616 | 1077559 | flagellar basal body P-ring protein FlgI |
| 30063546 | 1078596 | putative fimbrial-like protein |
| 30062940 | 1077910 | putative outer membrane protein |
| 30065426 | 1080665 | minor fimbrial subunit, precursor polypeptide |
| 30062779 | 1077721 | putative outer membrane protein |
| 30064194 | 1079329 | putative lipoprotein |
| 30063365 | 1078378 | flagellin |
| 30062298 | 1077222 | outer membrane protein X |
| 30064968 | 1080175 | putative major fimbrial subunit |
| 30061858 | 1076740 | outer membrane pore protein E (E, Ic, NmpAB) |
| 30062178 | 1080410 | minor lipoprotein |
| 30062479 | 1077412 | putative fimbrial-like protein |
| 30062565 | 1077506 | minor curlin subunit precursor |
| 30063880 | 1078972 | putative outer membrane lipoprotein |
| 30064531 | 1079686 | cytoplasmic membrane protein |
| 30065033 | 1080243 | putative receptor protein |
| \multicolumn{3}{c}{*Streptococcus mutans* UA159} |
| 24378550 | 1029610 | putative secreted antigen GbpB/SagA; putative peptidoglycan hydrolase |
| 24379087 | 1028055 | cell surface antigen SpaP |
| 24380463 | 1029310 | putative membrane protein |
| 24379075 | 1028046 | penicillin-binding protein 2b |
| 24378955 | 1027967 | penicillin-binding protein 1a; membrane carboxypeptidase |
| 24379801 | 1028662 | glucan-binding protein C, GbpC |
| 24379528 | 1029536 | hypothetical protein; possible cell wall protein, WapE |
| 24379231 | 1028158 | putative glucan-binding protein D; BglB-like protein |
| 24380488 | 1029325 | conserved hypothetical protein; possible transmembrane protein |
| 24380291 | 1029139 | putative amino acid binding protein |
| 24379342 | 1028247 | putative penicillin-binding protein, class C; fmt-like protein |
| 24380047 | 1028904 | putative ABC transporter, branched chain amino acid-binding protein |
| 24378698 | 1029755 | putative ABC transporter, metal binding lipoprotein; surface adhesin precursor; saliva-binding protein; lipoprotein receptor LraI (LraI family) |
| 24378708 | 1029768 | putative transfer protein |
| 24379427 | 1028331 | cell wall-associated protein precursor WapA |
| 24379272 | 1028196 | putative amino acid transporter, amino acid-binding protein |
| 24379641 | 1028511 | putative ABC transporter, amino acid binding protein |

TABLE 5-continued

New putative adhesins predicted by SPAAN in the genomes listed in table 2 -
(Total number = 279)

| Protein GI Number | Gene ID | Protein name |
|---|---|---|
| *Streptococcus pneumoniae* R6 | | |
| 15902395 | 934801 | Choline-binding protein |
| 15902381 | 934810 | Choline-binding protein F |
| 15902165 | 932894 | Surface protein pspA precursor |
| 15904047 | 934859 | Choline binding protein D |
| 15904036 | 933487 | Choline binding protein A |
| 15903986 | 933069 | Choline-binding protein |
| 15903796 | 933669 | Autolysin (N-acetylmuramoyl-L-alanine amidase) |
| *Neisseria meningitidis* Z2491 | | |
| 15794121 | 907145 | putative membrane protein |
| 15794144 | 907168 | putative surface fibril protein |
| 15793284 | 906275 | truncated pilin |
| 15793460 | 906456 | IgA-specific serine endopeptidase |
| 15793282 | 906273 | fimbrial protein precursor (pilin) |
| 15793337 | 906332 | adhesin |
| 15793253 | 906243 | putative lipoprotein |
| 15794356 | 907848 | putative lipoprotein |
| 15793684 | 906699 | putative membrane protein |
| 15793290 | 906281 | truncated pilin |
| 15793283 | 906274 | truncated pilin |
| 15793475 | 906471 | haemoglobin-haptoglobin-utilization protein |
| 15793406 | 906401 | porin, major outer membrane protein P.I |
| 15794985 | 907333 | adhesin MafA2 |
| 15794344 | 907836 | putative lipoprotein |
| 15794622 | 908118 | hypothetical outer membrane protein |
| 15793599 | 906604 | pilus-associated protein |
| 15793763 | 906779 | putative periplasmic binding protein |
| *Streptococcus pyogenes* MGAS8232 | | |
| 19745214 | 995235 | putative secreted protein |
| 19746570 | 994224 | putative penicillin-binding protein 1a |
| 19745593 | 994771 | putative 42 kDa protein |
| 19745813 | 993958 | putative adhesion protein |
| 19745225 | 994839 | putative choline binding protein |
| 19745828 | 995250 | streptolysin S associated protein |
| 19746229 | 995021 | putative minor tail protein |
| 19746909 | 994105 | putative laminin adhesion |
| 19745560 | 995061 | putative cell envelope proteinase |
| *Treponema pallidum* subsp. *pallidum* str. Nichols | | |
| 15639714 | 2611034 | flagellar hook protein (flgE) |
| 15639609 | 2611657 | tpr protein J (tprJ) |
| 15639111 | 2610909 | tpr protein C (tprC) |
| 15639125 | 2610968 | tpr protein D (tprD) |
| SARS coronavirus | | |
| 31581505 | | spike protein S [SARS coronavirus Frankfurt 1] |
| 32187357 | | spike protein S [SARS coronavirus HSR 1] |
| 32187342 | | spike glycoprotein [SARS coronavirus ZJ01] |
| 30698329 | | putative spike glycoprotein S [SARS coronavirus TW1] |
| 30421454 | | putative spike glycoprotein [SARS coronavirus CUHK-Su10] |
| 30027620 | | S protein [SARS coronavirus Urbani] |
| 29836496 | 1489668 | E2 glycoprotein precursor; putative spike glycoprotein [SARS coronavirus] |
| 30795145 | | spike glycoprotein [SARS coronavirus Tor2] |
| 31416295 | | spike glycoprotein S [SARS coronavirus GD01] |
| 30023954 | | putative E2 glycoprotein precursor [SARS coronavirus CUHK-W1] |
| 30275669 | | spike glycoprotein S [SARS coronavirus BJ01] |
| 29837498 | | 3C-like proteinase nsp5-pp1a/pp1ab (3CL-PRO) [SARS coronavirus] |
| 29837501 | | putative nsp8-pp1a/pp1ab [SARS coronavirus] |
| 29837503 | | putative nsp10-pp1a/pp1ab; formerly known as growth-factor-like protein [SARS coronavirus] |
| 29837502 | | putative nsp9-pp1a/pp1ab [SARS coronavirus] |

TABLE 6

Hypothetical proteins predicted as putative adhesins by SPAAN in the genomes listed in table 2 - (Total number of proteins = 105)

| Protein GI number | Gene ID |
|---|---|
| *Escherichia coli* O157:H7 | |
| 13363955 | 915578 |
| 13360000 | 914929 |
| 13362244 | 912369 |
| 13359999 | 914888 |
| 13361583 | 917316 |
| 13361172 | 913156 |
| 13361131 | 913207 |
| 13359780 | 914422 |
| 13360571 | 912499 |
| 13362197 | 912893 |
| 13362260 | 912399 |
| 13360947 | 913505 |
| 13361464 | 917196 |
| 13361635 | 917367 |
| 13362421 | 916655 |
| 13361463 | 917195 |
| *Haemophilus influenzae* Rd | |
| 16272115 | 951058 |
| 30995442 | 950581 |
| *Helicobacter pylori* J99 | |
| 4155526 | 889586 |
| 4155712 | 889748 |
| 4155632 | 889684 |
| 4156035 | 889468 |
| 4155499 | |
| *Mycoplasma pneumoniae* | |
| 13507870 | 877230 |
| 13508239 | 877245 |
| 13508109 | 876868 |
| 13508025 | 877084 |
| 13507838 | 876784 |
| 13507883 | 877183 |
| 13507871 | 877239 |
| 13507944 | 877056 |
| 13508241 | 876750 |
| 13507942 | 877055 |
| 13507840 | 877387 |
| 13507867 | 877242 |
| 13508201 | 877044 |
| 13507941 | 876985 |
| 13508114 | 877397 |
| *Mycobacterium tuberculosis* H37Rv | |
| 15611014 | 886198 |
| 15610173 | 887320 |
| 15609513 | 885515 |
| 15608094 | 885411 |
| 15610958 | 886155 |
| 15607528 | 886436 |
| 15607678 | 887473 |
| 15609587 | 885760 |
| 15610708 | 887227 |
| 15609526 | 885246 |
| 15611033 | 886225 |
| 15609028 | 885094 |
| 15607730 | 887771 |
| 15609121 | 885813 |
| 15608255 | 885951 |
| 15608409 | 887039 |
| 15609124 | 885815 |
| 15607734 | 887797 |
| *Rickettsia prowazekii* strain Madrid E | |
| 15604649 | 883964 |
| 15604322 | 883472 |
| 15604659 | 883996 |
| 15604417 | 883217 |

TABLE 6-continued

Hypothetical proteins predicted as putative adhesins by SPAAN in the genomes listed in table 2 - (Total number of proteins = 105)

| Protein GI number | Gene ID |
|---|---|
| *Porphyromonas gingivalis* W83 | |
| 34540233 | 2551594 |
| *Shigella flexneri* 2a str. 2457T | |
| 30062687 | 1077638 |
| 30062956 | 1080449 |
| 30063681 | 1078754 |
| 30065435 | 1080675 |
| 30063891 | 1078983 |
| 30063211 | 1078195 |
| 30065233 | 1080463 |
| 30064387 | 1079531 |
| 30062638 | 1077590 |
| 30065236 | 1080466 |
| 30061839 | 1076721 |
| *Streptococcus mutans* UA159 | |
| 24378864 | 1029452 |
| 24380475 | 1029319 |
| 24380237 | 1029088 |
| 24379203 | 1028139 |
| 24380480 | 1029320 |
| 24379275 | 1029489 |
| 24379291 | 1028216 |
| 24379295 | 1028215 |
| 24379804 | 1028663 |
| 24379162 | 1029417 |
| 24378987 | 1029363 |
| 24379179 | 1028118 |
| 24379166 | 1028107 |
| 24378827 | 1029444 |
| 24380216 | 1029067 |
| *Streptococcus pneumoniae* R6 | |
| 15902140 | 932867 |
| 15903446 | 934616 |
| 15903916 | 934001 |
| 15903848 | 933609 |
| 15902832 | 934332 |
| 15902372 | 934804 |
| 15902152 | 932889 |
| *Neisseria meningitidis* Z2491 | |
| 15793668 | 906680 |
| 15794714 | 907603 |
| *Streptococcus pyogenes* MGAS8232 | |
| 19747011 | 993608 |
| 19747024 | 994165 |
| 19747012 | 994373 |
| 19746396 | 995057 |
| 19746651 | 993824 |
| 19745883 | 995045 |
| 19745912 | 994077 |
| *Treponema pallidum* subsp. *pallidum* str. Nichols | |
| 15639844 | 2611061 |
| 15639720 | 2611059 |

TABLE 7

The list of 198 adhesins found in bacteria

| | |
|---|---|
| PapG (*E. coli*) | 12837502 |
| | 7407201 |
| | 7407207 |
| | 7407205 |
| | 147096 |

TABLE 7-continued

The list of 198 adhesins found in bacteria

| | |
|---|---:|
| | 4240529 |
| | 7407203 |
| | 42308 |
| | 7443327 |
| | 78746 |
| | 18265934 |
| | 26111419 |
| | 26250987 |
| | 26109826 |
| | 26249418 |
| | 13506767 |
| | 42301 |
| | 78745 |
| | 129622 |
| | 147092 |
| | 13506906 |
| | 7407209 |
| | 147080 |
| | 281926 |
| | 7407199 |
| | 147100 |
| | 78744 |
| SfaS (*E. coli*) | 477910 |
| | 264035 |
| | 42959 |
| | 134449 |
| | 96425 |
| FimH (*E. coli*) | 26251208 |
| | 26111640 |
| | 5524634 |
| | 29422425 |
| | 5524630 |
| | 29422435 |
| | 29422415 |
| | 10946257 |
| | 29422419 |
| | 11120564 |
| | 29422457 |
| | 11120562 |
| | 29422459 |
| | 5524632 |
| | 29422455 |
| | 29422453 |
| | 29422451 |
| | 29422449 |
| | 29422447 |
| | 29422445 |
| | 29422443 |
| | 29422437 |
| | 29422433 |
| | 29422431 |
| | 29422429 |
| | 29422427 |
| | 29422423 |
| | 29422421 |
| | 29422417 |
| | 729494 |
| | 1361011 |
| | 1790775 |
| | 3599571 |
| | 29422441 |
| | 12620398 |
| | 29422439 |
| | 5524628 |
| | 1787779 |
| | 1742472 |
| | 1742463 |
| | 15801636 |
| | 25321294 |
| | 12515169 |
| | 11120566 |
| | 24051859 |
| | 24112911 |
| | 13360484 |
| | 15800801 |
| | 15830279 |
| | 25392018 |
| | 25500156 |
| | 12514120 |
| | 1787173 |
| | 16128908 |
| | 16501811 |
| | 16759519 |
| | 24051219 |
| | 24112354 |
| | 30040724 |
| | 30062478 |
| | 6650093 |
| | 5524636 |
| | 1778448 |
| Intimin (*E. coli*) | 17384659 |
| | 4388530 |
| | 1389879 |
| | 15723931 |
| | 4323336 |
| | 4323338 |
| | 4323340 |
| | 4323342 |
| | 4323344 |
| | 4323346 |
| | 4323348 |
| | 4689314 |
| PrsG (*E. coli*) | 42523 |
| | 42529 |
| | 7443328 |
| | 7443329 |
| | 1172645 |
| HMW1 (Nontypeable *H. influenzae*) | 282097 |
| HMW2 (Nontypeable *H. influenzae*) | 5929966 |
| Hia (Nontypeable *H. influenzae*) | 25359682 |
| | 25359489 |
| | 25359709 |
| | 25359628 |
| | 25359414 |
| | 25359389 |
| | 21536216 |
| | 25359445 |
| HifE (*H. influenzae*) | 13506868 |
| | 13506870 |
| | 13506872 |
| | 13506874 |
| | 13506876 |
| | 3688787 |
| | 3688790 |
| | 3688793 |
| | 2126301 |
| | 1170264 |
| | 1170265 |
| | 533127 |
| | 535169 |
| | 3025668 |
| | 3025670 |
| | 3025672 |
| | 3025674 |
| | 642038 |
| MrkD (*K. pneumoniae*) | 127307 |
| FHA (*B. pertussis*) | 17154501 |
| Pertactin (*B. pertussis*) | 33571840 |
| YadA (*Y. enterocolitica*) | 10955604 |
| | 4324391 |
| | 28372996 |
| | 23630568 |
| | 32470319 |
| SpaP (*S. mutans*) | 26007028 |
| | 47267 |
| PAc (*S. mutans*) | 129552 |
| SspA (*Streptococcus gordonii*) | 25990270 |
| | 1100971 |
| CshA (*Streptococcus gordonii*) | 457707 |
| CshB (*Streptococcus gordonii*) | 18389220 |
| ScaA (*Streptococcus gordonii*) | 310633 |
| SspB (*Streptococcus gordonii*) | 25055226 |
| | 3220006 |
| SpaA (*Streptococcus sobrinus*) | 546643 |

TABLE 7-continued

The list of 198 adhesins found in bacteria

| | |
|---|---|
| PAg (*Streptococcus sobrinus*) | 217036 |
| | 47561 |
| Protein F (*Streptococcus pyogenes*) | 19224134 |
| PsaA (*Streptococcus pneumoniae*) | 18252614 |
| | 7920456 |
| | 7920458 |
| | 7920460 |
| | 7920462 |
| CbpA$^e$/SpsA/PbcA/PspC | 14718654 |
| (*Streptococcus pneumoniae*) | 2425109 |
| | 2576331 |
| | 2576333 |
| | 3153898 |
| | 9845483 |
| | 19548141 |
| FimA (*Streptococcus parasanguis*) | 97883 |
| SsaB (*Streptococcus sanguis*) | 97882 |
| EfaA (*Enterococcus faecalis*) | 493017 |
| FnbA (*Staphylococcus aureus*) | 120457 |
| FnbB (*Staphylococcus aureus*) | 581562 |
| | 21205592 |
| | 13702452 |
| BabA (*Helicobacter pylori*) | 13309962 |
| | 13309964 |
| | 13309966 |
| | 13309968 |
| | 13309970 |
| | 13309972 |
| | 13309974 |
| | 13309976 |
| | 13309978 |
| | 13309980 |
| | 13309982 |
| | 13309984 |
| | 13309986 |
| | 13309988 |
| | 13309990 |
| | 13309992 |
| | 13309994 |

Advantages:
1. The method helps in discovering putative adhesins, which are of great importance in drug discoveries and preventive therapeutics.
2. The method is useful in predicting the adhesive nature of even unique proteins, because it is independent of the homology of the query proteins with other proteins.
3. This method is easy to use. For calculating the output, only the amino acid sequence is required as input. No other information is required to get the information about its adhesive nature.

REFERENCES MAY BE MADE TO

1. Andrea, T. A., Kalayeh, H. (1991) Applications of neural networks in quantitative structure-activity relationships of dihydrofolate reductase inhibitors. J. Med. Chem. 34, 2824-2836.
2. Altschul S F, Gish W, Miller W, Myers E W, Lipman D J. (1990) Basic local alignment search tool. J Mol Biol. 215 (3), 403-410.
3. Bassinet L, Gueirard P, Maitre B, Housset B, Gounon P, Guiso N. (2000) Role of adhesins and toxins in invasion of human tracheal epithelial cells by Bordetella pertussis. Infect Immun. 68(4), 1934-1941.
4. Bock, K., et al. (1985). Specificity of binding of a strain of uropathogenic *Escherichia coli* to Gal alpha 1-4Gal-containing glycosphingolipids. J. Biol. Chem. 260, 8545-8551.
5. Brendel, V., Bucher, P., Nourbakhsh, I. R., Edwin Blaisdell, B., and Karlin, S. (1992) Methods and algorithms for statistical analysis of protein sequences: Proc. Natl. Acad. Sci. USA 89, 2002-2006.
6. Brennan, M. J., Delogu, G., Chen, Y., Bardarov, S., Kriakov, J., Alavi, M., Jacobs, W. R., (2001).
7. Evidence that Mycobacterial PE_PGRS proteins are cell surface constituents that influence interactions with other cells. Infect. Immun, 69, 7326-7333.
8. De B K, Woolfitt A R, Barr J R, Daneshvar M I, Sampson J S, Ades E W, Carlone G M. (2003) Analysis of recombinant acylated pneumococcal surface adhesin A of *Streptococcus pneumoniae* by mass spectrometry. Arch Biochem Biophys. 15, 419(2), 147-157.
9. Egland P G, Du L D, Kolenbrander P E (2001) Identification of independent *Streptococcus gordonii* SspA and SspB functions in coaggregation with Actinomyces naeslundii. Infect Immun. 69(12), 7512-7516
10. Finlay, B. B. and Falkow, S. (1997) Common themes in microbial pathogenicity revisited. Microbiol. Mol. Biol. Rev. 61, 136-169,
11. Fraser, C. M., Eisen, J., Fleischmann, R. D., Ketchum, K. A., Peterson, S. (2000) Comparative genomics and understanding of microbial biology. Emerg. Infect. Dis. 6,505-6512
12. Halperin, S. A., Scheifele, D., Mills, E., Guasparini, R., Humphreys, G., Barreto, L., Smith, B. (2003) Nature, evolution, and appraisal of adverse events and antibody response associated with the fifth consecutive dose of a five-component acellular pertussis-based combination vaccine. Vaccine 21, 2298-2306.
13. Hartford O, McDevitt D, Foster T J. (1999) Matrix-binding proteins of *Staphylococcus aureus*: functional analysis of mutant and hybrid molecules. Microbiology. 145 (Pt 9), 2497-2505.
14. Hobohm, U. and Sander, C. (1995) A sequence property approach to searching protein databases. J. Mol. Biol. 251, 390-399.
15. Ide T, Michgehl S, Knappstein S. Heusipp G, Schmidt M A. (2003) Differential modulation by Ca2+ of type III secretion of diffusely adhering enteropathogenic *Escherichia coli*. Infect Immun. 71(4), 1725-1732.
16. Langermann S et al. (2000) Vaccination with FimH adhesin protects cynomolgus monkeys from colonization and infection by uropathogenic *Escherichia coli*. J. Infect. Dis. 181, 774-778.
17. Lowe A. M., Lambert, P. A., Smith, A. W. (1995) Cloning of an *Enterococcus faecalis* endocarditis antigen: homology with adhesins from some oral streptococci. Infect Immun. 63, 703-706.
18. Maurer, L., Orndorff, P. (1987). Identification and characterization of genes determining receptor binding and pilus length of Escherichia coli type 1 pili. J. Bacteriol. 169, 640-645
19. Marchler-Bauer A, Panchenko A R, Shoemaker B A, Thiessen P A, Geer L Y, Bryant S H. (2002) CDD: a database of conserved domain alignments with links to domain three-dimensional structure. Nucleic Acids Res. 1, 30(1), 281-283.
20. Neubauer H, Hensel A, Aleksic S, Meyer H. (2000) Evaluation of a *Yersinia* adhesion gene (yadA) specific PCR for the identification of enteropathogenic *Yersinia enterocolitica*. Int J Food Microbiol. 15, 57(3),-225-227.
21. Nishikawa, K., Kubota, Y. and Ooi, T. (1983) Classification of proteins into groups based on amino acid composition and other characters. II. grouping into four types. J. Biochem. 94, 997-1007.

22. Peregrin-Alvarez, J. M., Tsoka, S., Ouzounis, C. A. (2003) The phylogenetic extent of metabolic enzymes and pathways. Genome Res. 13, 422-427.
23. Prinz, C., Hafsi, N. Voland, P. (2003) Helicobacter pylori virulence factors and the host immune response: implications for therapeutic vaccination. Trends in Microbiol. 11, 134-138.
24. Rapola, S., Jäntti, V., Eerola, M., Helena Mäkelä, P., Käyhty, H., Kilpi, T. (2003).Anti-PsaA and the risk of pneumococcal AOM and carriage. Vaccine 21,3608-3613.
25. Rison, S. C., Teichmann, S. A., Thornton, J. M. (2002) Homology, pathway distance and chromosomal localization of the small molecule metabolism enzymes in *Escherichia coli*. J. Mol. Biol. 318, 911-932
26. Sperandio V, Bailey C, Giron-J A, DiRita V J, Silveira W, Vettore A L, Kaper J B. (1996) Cloning and characterization of the gene encoding the OmpU outer membrane protein of Vibrio cholerae. Infect Immun. 64(12), 5406-5409.
27. St Geme J W 3rd, Cutter D. (2000) The *Haemophilus influenzae* Hia adhesin is an autotransporter protein that remains uncleaved at the C terminus and fully cell associated. J Bacteriol. 182(21), 6005-6013.
28. Thompson, J. D., Higgins,. D. G., Gibson, T. J. (1994) CLUSTAL W: improving the sensitivity of progressive multiple sequence alignment through sequence weighting, position-specific gap penalties and weight matrix choice. Nucleic Acids Res. 22, 4673-4680
29. Van Schilfgaarde M, van Ulsen P, Eijk P, Brand M, Stam M, Kouame J, van Alphen L, Dankert J. (2000) Characterization of adherence of nontypeable *Haemophilus influenzae* to human epithelial cells. Infect Immun. 68(8), 4658-4665.
30. Wizemann, T. M., Adamou, J. E., Langermann, S. (1999). Adhesins as targets for vaccine development. Emerg. Infect. Dis. 5, 395-403,
31. Wolf, Y. I., Rogozin, I. B., Kondrashov, A. S., and Koonin, E. V. (2001) Genome alignment, evolution of prokaryotic genome organization and prediction of gene function using genomic context. Genome Res.11, 356-372
32. Yu J, Leung W K, Go M Y, Chan M C, To K F, Ng E K, Chan F K, Ling T K, Chung S C, Sung J J. (2002) Relationship between Helicobacter pylori babA2 status with gastric epithelial cell turnover and premalignant gastric lesions. Gut. 51(4), 480-484.
33. Zuegge, J., Ralph, S., Schmuker, M., McFadden, G. I., Schneider, G. (2001) Deciphering apicoplast targeting signals—feature extraction from nuclear-encoded precursors of Plasmodium falciparum apicoplast proteins. Gene 280, 19-26.

SEQUENCE LISTING (763 sequences)

SEQ ID NO: 1 - protein, 1268 aa, Escherichia coli 0157:H7
MINLSKEATVGKALTPIAILMMLSFPVASQAAGLVIKNGTVYNANGVPVVDINKPNGSGLSHNIWDNLNVDKNGVVFNNSANESSTSLAGNIQGNSNLTSGSAKVILNEVTSKNPSTINGMMEVAGDKADLIIANPNGITVNGGGSINTGKLTLTTGTPDIQDDKLAGYSVNGGTITLGKLDNASPTEILSRNVVVNGKVSADELNVVAGNNYVNAAGQVTGSVSATGSRNGYSVDVAKLGGMYANKISLVSTEKGVGVRNLGVIAGGVNGVSIDSKGNLLNSNAQIQSASTINLTTNGTLDNTTGTVTSVGTISLNTNKNTIVNTRAGNISTMGDIYVNSGTIDNTNGKLAAAGMLAVDTNNATLINSGKGSSVGIEAGLVALKTGTLNNSNGQIRGGYVGLESAALNNNNGDIQTTGDIAIISNGNVDNNKGLIRSSTGHIVIGAAGSVNNGSTKTADTGSSDSLGIIADTGVEIGANNINNNGGQIASNGNVSLSSYSTIDDYAGKILSNSKVIIKGSSLRNDTGGISGKQGIEVAVGGSLTNNIGVISSEEGDISLLANSVDNHGGFMMGQNITMESMSGVNNNTALIVASKKLKINARGSIENRDGNNFGNAYGLYFGMPQQTGGMVGKEGIELSGQNIYNNNSRLIAEDGPLTLQAQNTFDNTRALVTSGADASIQVGGTYYNNYATTWSAGNLDIDATTLQNSSSGTMIDNNATGFIASDKNLSLEVVNSLTNYGWISGKGDVDVTVNNGNLYNRNTIAAEKGLDIAALNGIENWKDISAGGDLTMNTNRHVTNNSNSNMVGQNIVINAVNDINNRGNIVSDADLNVTTKGNLYNYLYMVGYGDIALSANSVANNNATIEATGDLIIDSKGNVGNNRGNLHALNGVLSVKGNNLNNDNGEIRGYGDVTLALTGNYDSYKGSLTSETGDVTLTANIVDNAYGLIAGENVSVDAKSTIYNNTALIAANKKLVINAGGNLENRDGNNFLRNNGALFGITDNVGGIVGKEGVTLSAQNVYNNNSSIIAENGPLNLLSRGTLDNTRALLSSGADAIIRAAGTFYNNYATTYSAGNLDVYAASLNNASDGRLEDNTATGVIASDKNLDLSVDNSVTNYGWISGKGDVHFNVLKGTLYNRNAIAADNALTINALNGVENFKDIVAGTALTIDTQKYVTNNSNSNMLGQTIAINAVNDINNRGNIVGDYSLGVKTTGNIYNYLNMLSYGVAGVSANKVTNSGKDAVLGGFYGLALEANETDNTGTIVGM

SEQ ID NO: 2 - protein, 1571 aa, Escherichia coli 0157:H7
MNTIHLRCLFRMNPLVWCLWADVAAKLRSLKRYSVFTFQRMKFMNRTSPYYCRRSVLSLLISALIYAPPGMAAFTPDVIGVVNDETVDGSQRVDERGTTNNTHIINHGQQNVYGGVSNGSLIESGGYQDVGRHNNYVGQSNNTTINGGRQSIHDGGISTGTIIESGNQDVYKGGISNGTTIKGGASRVEGGSANGTLIDGGSQIVKVQGHADGTTINKSGSQDVVQGSLATNTTINGGRQYVEQSTVETTTIKNGGEQRVYESRALDTTIEGGTQSLNSKSTAKNTQIYSGGTQIIDNTSSSDVIEVYSGGVLDVSGGTATNVTQHDGAILKTNTNGTTVSGTNSEGAFSIHNHVADNVLLENGGHLDINAYGSANKTIIKDKGTMSVLTNAKADATRIDNGGVMDVAGNATNTIINGGTQNINNYGIATGTNINSGTQNIKSGGKADTTIISSGSRQVVEKDGTAIGSNISAGGSLIVYTGGIAHGVNQETGSALVANTGAGTDIEGYNKLSHFTITGGEANYVVLENTGELTVVAKTSAKNTTIDAGGKLIVQKEAKTDSTRLNNGGVLEVQDGGEAKHVEQQSGGALIASTTSGTLIEGTNSYGDAFYIRNSEAKNVVLENAGSLTVVTGSRAVDTIINANGKMDVYGKDVGTVLNSAGTQTIYASATSDKANIKGGKQTVYGLATEANIESGEQIVDGGSTEKTHINGGTQTVQNYGKAINTDIVSGLQQIMANGTAEGSIINGGSQIVNEGGLAENSVLNDGGTLDVREKGSATGIQQSSQGALVATTRATRVTGTRADGVAFSIEQGAANNILLANGGVLTVESDTSSDKTQVNTGGREIVKTKATATGTTLTGGEQIVEGVANETTINDGGIQTVSANGEAIKTTINEGGTLTVNDNGKATDIVQNSGAALQTSTANGIEISGTHQYGTFSISGNLATNMLLENGGNLLVLAGTEARDSTVGKGGAMQNQGQDSATKVNSGGQYTLGRSKDEFQALARAEDLQVAGGTAIVYAGTLADASVSGATGSLSLMTPRDNVTPVKLEGAIRITDSATLTIGNGVDTTLADLTAASRGSVWLNSNNSCAGTSNCEYRVNSLLLNDGNVYLSAQTAAPATTNGIYNTLTTNELSGSGNFYLHTNVAGSRGDQLVVNNNATGNFKIFVQDTGVSPQSDDAMTLVKTGGGDASFSLGNTGGFVDLGTYEYVLKSDGNSNWNLTNDVKPNPDPNPNPNPNPKPDPKPDPKPDPKPDPTPEPTPTPVPEKRITPSTAAVLNMAATLPLVFDAELNSIRERLNIMKASPHNNNVWGATYNTRNNVTTDAGAGFEQTLTGMTVGIDSPNDIPEGIATLGAFMGYSHSHIGFDRGGHGSVGSYSLGGYASWEHESGFYLDGVVKLNRFESNVAGKMSSGGAANGSYHSNGLGGHIETGMRFTDGNWNLTPYASLTGFTADNPEYHLSNGMESKSVDTRSIYRELGATLSYNMRLGNGMEIEPWLKAAVRKEFVDDNRVKVNNDGNFVNDLSGRRGIYQAGIKASFSSTLSGHLGVGYSHGAGVESPWNAVAGVNWSF

SEQ ID NO: 3 - protein, 971 aa, Escherichia coli 0157:H7
MAVKISGVLKDGTGKPVENCTIQLKARRNSATVVVNTVASENPDEAGRYSMDVEYGQYSVILLVEGFPPSHAGTITVYEDSQPGTLNDFLGAMTEDDVRPEALRRFELMVEEVARNASAVAQNTAAAKKSASDASTSAREAATHATDAADSARAASTSAGQAASSAQSASSSAGTASTKATEASKSAAAAESSKSAAATSAGAAKTSETNAAVSQQSAATSASTATTKASEAASSARDASASKEAAKSSETSAASSASSAASSATAAGNSAKAAKTSETNAKSSETAAEQSASAAAGSKTAAALSASAASTSAGQASASATAAGKSAESAASSASTATTKAGEATEQASAAASSASAAKTSETNAKASETSAESSKTAAASSASSAASSASSASASKDEATRQASAAKSSATTASTKATEAAGSATAAAQSKSTAESAATRAETAAKRAEDIASAVALEDASTTKKGIVQLSSATNSTSESLAATPKAVKAAYELANGKYTAQDATTAQKGIVQLSNATNSTSEMLAATPKSVKAAYDLANGKYTAQDATTAQKGIVQLSSATNSASETLAATPKAVKAANDNANGRVPSARKVNGKALSSDITLTPKDIGTLNSTTMSFSGGAGWFKLATVTMPQASSVVSITLIGGAGFNVGSPQQAGISELVLRAGNGNPKGITGALWQRTSTGFTNFAWVNTSGDTYDIYVAIGNYATGVNIQWDYTSNASVTIHTSPAYSANKPEGLTDGTVYSLYTPSEQFYPPGAPIPWPSDTVPSGYALMQGQTFDKSAYPKLAAAYPSGVIPDMRGWTIKGKPASGRAVLSQEQDGIKSHTHSASASSTDLGTKTTSSFDYGTKSTNNTGAHTHSVSGTAASAGNHTHSVTGASAVSQWSQNGSVHKVVSAASVNTSAAGAHTHSVSGTAASAGAHAHTVGIGAHTHSVAIGSHGHTITVNAAGNAENTVKNIAFNYIVRLA

SEQ ID NO: 4 - protein, 300 aa, Escherichia coli 0157:H7
MKRVITLFAVLLMGWSVNAWSFACKTANGTAIPIGGGSANVYVNLAPAVNVGQNLVVDLSTQIFCHNDYPETITDYVTLQRGSAYGGVLSNFSGTVKYSGSSYPFPTTSETPRVVYNSRTDKPWPVALYLTPVSSAGGVAIKAGSLIAVLILRQTKNYNSDDFQFVWNIYANNDVVVPTGGCDVSARDVTVTLPDYPGSVPIPLTVYCAKSQNLGYYLSGTTADAGNSIFTNTASFSPAQGVGVQLTRNGTIIPANNTVSLGAVGTSAVSLGLTANYARTGGQVTAGNVQSIIGVTFVYQ

SEQ ID NO: 5 - protein, 182 aa, Escherichia coli 0157:H7
MGYVTGGLPMKNNRAWALISGLILFSGTAPAADNLHFTGNLLGKSCTPVINGNLLAEIHFPTIAASDLMQRGQSDRVPLVFQLKDCKSTTAFNVKVTLMGTEDTDLPGFLSIDSSSSATGVGIGIETAGGAAVPINSTTGASFPLNQGNNSVNFNAWLQTVNGRNVTSGDFTATMTVTFEYF

SEQ ID NO: 6 - protein, 949 aa, Escherichia coli 0157:H7
MKRHLNTSYRLVWNHITGTLVVASELARSRGKRAGVAVALSLAAVTSVPALAADKVVQAGETVNDGTLTNHDNQIVFGTANGMTISTGLELGPDSEENTGGQWIQNGGIAGNTTVTTNGRQVVLEGGTASDTVIRDGGGQSLNGLAVNTTLNNRGEQWVHEGGVATGTIINRDGYQSVKSGGLATGTIINTGAEGGPDSDNSYTGQKVQGTAESTTINKNGRQIILFSGLARDTLIYAGGDQSVHGRALNTTLNGGYQYVHRDGLALNTVINEGGWQVVKAGGAAGNTTINQNGELRVHAGGEATAVTQNTGGALVTSTAATVIGTNRLGNFTVENGKADGVVLESGGRLDVLESHSAQNTLVDDGGTLAVSAGGKATSVTITSGGALIADSGATVEGTNASGKFSIDGTSGQASGLLLENGGSFTVNAGGQAGNTTVGHRGTLTLAAGGSLSGRTQLSKGASMVLNGDVVSTGDIVNAGEIRFDNQTTPNAALSRAVAKSNSPVTFHKLTTTNLTGQGGTINMRVRLDGSNASDQLVINGGQATGKTWLAFTNVGNSNLGVATTGQGIRVVDAQNGATTEEGAFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMTFGEGTSSRDTLRDSAKHSVSELPVNWWVQPSVIRTFSSRGDMSMGTAAAGSNMTFSPSRNGTSLDLQAGLEARIRENITLGVQAGYAHSVSGSSAEGYNGQATLNMTF

SEQ ID NO: 7 - protein, 360 aa, Escherichia coli 0157:H7
MKKWHYIFCIILFHLGLPCGYAANDGTCATRGGTHTLSLNFPLTTVSAANNVPGNTLIDIANATSSENYSVLCNCDSKHSNGAYHEIYYTADPAPGMVYSTTASGLAFYYLNEYVDVGTKISVLNAGYTAVPFEHVSNQATTTDHTCQGNKTTAVGVSLKTGADAKISFRIKRSINGTVVIPITDIALLYANISSTTTRGEAIAKVRISGSLTAPQSCQINAGQVIYFDFDTIPASEFSSTAGQAITSRKITKTVSIECTGMGYERTQKVDASFTGTNRSSDDTMVATDNADVGIKIYNKSNAEVSVNNGKLPADMGNTTIFGRKNGSVTFSAAPASFTGARPQPGVFNATATLTIEFVN

SEQ ID NO: 8 - protein, 1417 aa, Escherichia coli 0157:H7
MSRYKTGHKQPRFRYSVLARCVAWANISVQVLFPLAVTFTPVMAARAQHAVQPRLSMGNTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDIEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLAKQLDTDSIRERRVLAGSRYDLVERNNNIVLEYRKSEVIRIALPERIEGKGGQTLSLGLVVSKATHGLKNVQWEAPSLLAEGGKITGQGSQWQVTLPAYRPGKDNYYAISAVAYDNKGNTSKRVQTEVVITGAGMSADRTALTLDGQSRIQMLANGNEQKPLVLSLRDAEGQPVTGMKDQIKTELTFKPAGNIVTRSLKATKSQAKPTLGEFTETEAGVYQSVFTTGTQSGEATITVSVDGMSKTVTAELRATMMDVANSTLSANEPSGDVVADGQQAYTLTLTAVDSEGNPVTGEASRLRFVPQDTNGVTVGAISEIKPGVYSAAVSSTRAGNVVVRAFSEQYQLGTLQQTLKFVAGPLDAAHSSITLNPDKPVVGGTVTAIWTVKDAYDNPVTSLTPEAPSLAGAAAEGSTASGWTNNGDGTWTAQITLGSTAGELEVMPKLNGQNAAANAAKVTVVADALSSNQSKVSVAEDHVKAGESTTVTLVAKDAHGNAISGLALSASLTGTASEGATVSSWTEKGNGSYVATLTTGGKTGELRVMPLFNGQPAATEAAQLTVIAGEMSSANSTLVADNKAPTVKTTTELTFTVKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQLANGQSANQITLTVVDTYGNPLQGQEVTLTLPQGVTSKTGNTVTTNAAGKADIELMSTVAGEHNISASVNGAQKTVTVKFNADASTGQANLQVDAAAQKVANGKDAFTLTANVEDKNGNPVPGSLVTFNLPRGVKPLTGDNVWVKANDEGKAELQVVSVTAGTYEITASAGNSQPSNTQTITFVADKATATVSGIEVIGNYALADGNAKQTYKVTVTDANNNLLKDSEVTLTASPANLVLTPNGTAKTNEQGQAIFTATTTVAAKYTLTAKVSQADGQESTKTAESKFVADDTNAVLTASSDVTSLVADGISTAKLEVTLMSANNPVGGNMWVDIKTPEGVTEKDYQFLPSKNDHFVSGKITRTFSTSKPGVYTFTFNALTYGGYEMKPVTVTITAVDADTAKGEEAMN

SEQ ID NO: 9 - protein, 1579 aa, Escherichia coli 0157:H7
MARGWASSEASGAMTDWLNNFGTARISLGVDEDFSLKNSQFDFLHPWYDTPDYLLFSQHTLHRTDDRTQINTGLGWRHFTSSWMSGINLFFDHDLSRYHSRAGLGAEYWRDYLKLSSNAYIGLTGWRSAPELDNDFEARPANGWDLRAEGWLPAWPQLGGKLVYEQYYGDEVALFDKNDRQSNPHAITAGLNYTPFPLLTLSAEQRQGKQGENDTRFAVDLTWQPSSSMQKQLNPDEVAGRRSLAGSRYDLIDRNNNIVLEYRKKELIRLSLLDPVKGKSGEIKPLVSSLQTKYALKGYNIEAAALEAAGGKVSTSGKDITVTLPGYRFTNTPETDNTWSIDVTAEDVKGNLSRHEQSMVVIQAPTLSQKDSLLSVNPLTVAADKKSTTTLTVTAHDSDGTPVPGLALQTRSEGVQDITLSDWTDNGDGSYTQILTAGTTSGSVTLTPQINGESAVKESIVVNIVPVVSSRDHSSITIDNVSYYAGDDIKVRVELKDDSNQPVAYQKEELVKAVTVENSKPGATIVWHEEQPGVYAANYPAYKQGTALRAQLSLHNWNAPLQSHIYNIEANQNKARVATLSATNNDVYADKKTFNTLTINVTDESDNPLTNHQVTFKNEKGSAEFVEPPQQNTDAYGVATINMVSQVAEENTISATLPNGFSQRIIAKFVSDSSTPKFKQLVADPDTIIAGNSQGSTLTAIITDFHNNPLKDMKVNFVAPGGSQLDNTTATTDQSGIVRVHLTSSKAGSYSVDASLEVDKNIHQSVTITVVPNREQSVMTLNAGSGSAIANNTNIVTLTASVKDVYGHPLPDEDVKFTLPASMTGNFTLSSETARTDANGDAVVTLRGTKAGEFTVTATLTRNNTVAYQQVTFIGDTNSAQLQPLTASLNSIVAGNSTGSTLTATILDAYQNPLKDQLVTFQSNDVTLSETEVTTNTLGQATVTMTSNIAGQHNVVVSRKAQASDNKTFSLSVLPDESSAKVISITGAEKTITVGENITLRILVQDAFNNVIAGQRVRLSAQPTTNITIGDTAYTDNNGYAYVNLLSTQPGVYQVTATLDNNSSSKVDVNVANGKLELTSSKPETTVHNSEGITLTATARNARGELMPGQIITFSVTPEGATLSNTGEVLTDQSGQAKVTLTSDKVNVYTVTAIMGKDVPVQSQVTVAVKADAKTAHVVSVVASPDTITADGIDSSTITSRVEDDYGFPVEGVDISHGLDTKGSPVVNIPTTRTDQSGQVTATITSTLAETLTVNVQVPGTANQSATITLVAGTADESKSILKSDVDTLKADYQQSAKLTLTLQDKYGNPIVTSDHLEFVQSGPFVNFLKLSDIDYSQRNYGEYTVTVTGGKEGTATLIPMLNGVHQANLSISLNLIQSIKEMSGHVTANNHTFSTAKFPSEGFAGAYYTLNNDNFEAGKTVDDYMFSSSQGWVSVDASGKVSFANIGDQTSVTISAVPRQGGTTYQTLIKLKGWWVNNGNHTNIWLAANALCHAKNDGYNLPGITHLTSGENKRTQGSLYGEWGNVGAFSSNSQFTPGAYWTSESDDYSRHYYVQMLTGMTGSDADSSPQLTACRKSL

SEQ ID NO: 10 - protein, 934 aa, Escherichia coli 0157:H7
MITHGCYTRTRHKHKLKKTLIMLSAGLGLFFYVNQNSFANGENYFKLGSDSKLLTHDSYQNRLFYTLKTGETVADLSKSQDINLSTIWSLNKHLYSSESEMMKAAPGQQIILPLKKLPFEYSALPLLGSAPLVAAGGVAGHTNKLTKMSPDVTKSNMTDDKALNYAAQQAASLGSQLQSRSLNGDYAKDTALGIAGNQASSQLQAWLQHYGTAEVNLQSGNNFDGSSLDFLLPFYDSEKMLAFGQVGARYIDSRFTANLGAGQRFFLPANMLGYNVFIDQDFSGDNTRLGIGGEYWRDYFKSSVNGYFRMSGWHESYNKKDYDERPANGFDIRFNGYLPSYPALGAKLIYEQYYGDNVALFNSDKLQSNPGAATVGVNYTPIPLVTMGIDYRHGTGNENDLLYSMQFRYQFDKSWSQQIEPQYVNELRTLSGSRYDLVQRNNNIILEYKKQDILSLNIPHDINGTEHSTQKIQLIVKSKYGLDRIVWDDSALRSQGGQIQHSGSQSAQDYQAILPAYVQGGSNIYKVTARAYDRNGNSSNNVQLTITVLSNGQVVDQVGVTDFTADKTSAKADNADTITYTATVKKNGVAQANVPVSFNIVSGTATLGANSAKTDANGKATVTLKSSTPGQVVVSAKTAEMTSALNASAVIFFDQTKASITEIKADKTTAVANGKDAIKYTVKVMKNGQPVNNQSVTFSTNFGMFNGKSQTQATTGNDGRATITLTSSSAGKATVSATVSDGAEVKATEVTFFDELKIDNKVDIIGNNVRGELPNIWLQYGQFKLKASGGDGTYSWYSENTSIATVDASGKVTLNGKGSVVIKATSGDKQTVSYTIKAPSYMIKVDKQAYYADAMSICKNLLPSTQTVLSDIYDSWGAANKYSHYSSMNSITAWIKQTSSEQRSGVSSTYNLITQNPLPGVNVNTPNVYAVCVE

SEQ ID NO: 11 - protein, 226 aa, Escherichia coli 0157:H7
MLVLSESFKNKLLPMNGYMKGGSDSGSKAQARATEKGIELQREMWQTNMQNLAPFTPLAQQYVSQLQNLSSLQGQGQALNQYYNSQQYKDLAGQARYQSLAAAEATGGLGSTATGNQLAAIAPTLGQNWLSGQMNNYNNLANIGLGALTGQANAGQNYANNVSQLYQQQAAASAANANKPSGLQSFATGAIGGAASGAMIGSAVPVIGTGIGALAGGVIGGLGSLF

SEQ ID NO: 12 - protein, 356 aa, Escherichia coli 0157:H7
MKKILSGLILLLCCPYGFAANGDGATHMSNLSFGPLTVAAANNHSGYNIFEALSNTTGTYPVRCHCDDTHGGPGQQTAFFPIFYTGDAAPGLVLERTLNGLNYYALNDYLSVGVTIFIINNQYAAIPFEHLSNQSTSPQHTCGAGNNGSTVNLDSGRSAKLSFYVRHSITGTVTIPTTEVAWLYAGMSDHFPKTTPVSKVTIRGQLTAPQNCELTPNQSIDVDFQKINSAEFSSTAGSIIAERKIKTEVTVSCTGMEDVRSTEVVSASMIAANRSADATMIVTSNPDVGIKIFDKNDRPVNVDGGNLPADMGAISRLGKTDGSVTFYSAPASLTGAKPAPDNGFTATATLVIEFTN

SEQ ID NO: 13 - protein, 1327 aa, Escherichia coli 0157:H7
MNKIYRLKWNRSRNCWSVCSELGSRVKGKKSRAVLISAISLYSSLVFADDVIVNQDKTIDFGKENQSIDYRITVTDNANLVINATDTSRPRLTLASGGGLDITGGKVTINGPLNFLLKGTGFLNVSNAGSELYADDLYESNSGMRHDRGYFNVSNGGKIHVKGTSRLTYLQGNVSGEGSQVNSETFFMGVYGSYGGNQYLSVNNGGEVNARKQISLGYYDQVSDTTLAVSEGGKISAPTISLSTNSELALGAQEGSAAKAAGIIDAEKIEFVWAKTSEKKITLNHTDKDATISADIVSGSEGLGYINALNGTTYLTGDNSAFSGKVKIEQNGALGITQNIGTAEINNRGKLHLKADDSMTFANKISGNGTISIDSGTVELTGNNYAFSGYIDVASGAVAVISEDKNIGRAELDVDGKLQINANKDWVFDNDLEGRGIVEINMGNHEFSFDEFAYTDWFQGSLAFQNTTFNLEKNAEFLQKGGITAGQGSLVTVGKGAHSISTLGFSGGTVDFGALTAGAQMTEGTVNVSKTLDLRGEGVIQVSDSDVVRSVSRDIDSALSLTEVDDGNSTIKLVDAQGAEVLGDAGNLQLQDKNGQILSSSAQRDIQQNGQKAAVGTYDYRLTSGVNNDGLYIGYGLTQLDLHATDSDALVLSSNGKSENAADLSAKITGSGDLAFSSQKGQTVSLSNKDNDYTGVTDLRSGTLLLNNDNVLGNTHELRLAAETELDMNGHSQTVGTLNGSADSLLSLNGGSLTVTNGGTSTGSLTGSGELNIQGGTLDIAGDNSNLTANVNIANSANVLVSHAQGLGSANVENNGTLALNNSAEKRAAASVNYALGGNLTNNGTLMTGMSGQQAGNVLVVKGNYHGNNGQLVMNTVLNGDDSVTDKLVVEGDTSGTTAVTVNNAGGTGAKTLNGIELIHVDGKSEGEFVQAGRIVAGAYDYTLARGQGANSGNWYLTSGSDSPELQPEPDPMPNPEPNPNPEPNPNPTPTPGPDLNVDNDLRPEAGSYIANLAAANTMFTTRLHERLGNTYYTDMVTGEQKQTTMWMRHEGGHNKWRDGSGQLKTQSNRYVLQLGGDVAQWSQNGSDRWHVGVMAGYGNSDSKTISSRTGYRAKASVNGYSTGLYATWYADDESRNGAYLDSWAQYSWFDNTVKGDDLQSESYKSKGFTASLEAGYKHKLAEFNGSQGTRNEWYVQPQAQVTWMGVKADKHRESNGTLVHSNGDGNVQTRLGVKTWLKSHHKMDDGKSREFQPFVEVNWLHNSKDFSTSMDGVSVTQDGARNIAEIKTGVEGQLNANLNVWGNVGVQVADRGYNDTSAMVGIKWQF

SEQ ID NO: 14 - protein, 182 aa, Escherichia coli 0157:H7
MITMKKSVLTAFITVVCATSSVMAADDNAITDGSVTFNGKVIAPACTLVAATKDSVVTLPDVSATKLQTNGQVSGVQTDVPIELKDCDTTVTKNATFTFNGTADTTQITAFANQASSDAATNVALQMYMNDGTTAIKPDTETGNILLQDGDQTLTFKVDYIATGKATSGNVNAVTNFHINYY

SEQ ID NO: 15 - protein, 187 aa, Escherichia coli 0157:H7
MSKFVKTAIAATMVMGAFASTSTIAAGNNGTARFYGTIEDSPCSIVPDDHKLEVDMGDIGSGILKNNGTSTPKAFQIHLQDCVFDTQTTMTTTFTGNASSTNSGNYYTIYNTDTGAAFNNVSLAIGDAQGTSYKSGAGIEQKIVNDTATNKGKAKQTLDFKAWLVGAADAPDLGNFEANTTFQITYL

SEQ ID NO: 16 - protein, 1250 aa, Escherichia coli 0157:H7
MRVIFLRKEYLSLLPSMIASLFSANGVAAAIDLCQGYDIKASCHASRQSLSGITQVWSIADGQWLVFSDMTNNASGGAVFLQQGAEFTLSPENETGMTLFANNTVSGEYNNGGAIFAKENSTLNLTDVIFSGNVAGGYGGAIYSSGTNDTGAIDLRVTNAVFRNNIANDGKGGAIYTINNDIYLSDDVFNNNQAYTSTSYSDGDGGAIDVTDNNSDSKHPSGYTIINNTAFTNNTAEGYGGAIYTNSATAPYLIDISVDDSYSQNGGVLVDENNSAAGYGDGPSSAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDKYQNQAELNVGSTQQTFAHSLTGFQNGTLNIDAGGNVTVNQGSFAGTIEGAGQLTIAQNGSYVLAGAQSMALTGDIVVDAGAVLSLEGDAADLAALQDDPQSIVLNGGMLDLSDFSTWQSGTSYKDGLEVSGSSGTVIGSQDVVDLAGGNDMHIGGDGKDGVYVVIDAGDGQVSLANDNQYLGTTQIASGTLMVSDNSQLGYTHYNRQVIFTDKPQESVMEITANVDTRSTTTEHGRDIEMRADGEVAVDAGVDTQWGALMADSSGQHQDEGSTLTKTGAGTLELTASGTTQSAVRVEEGTLQGDVADIFPYASSLWVGDGATFVTGADQDIQSIDATSSGTIDISDGTVLRLTGQDTSVALNASLFNCDGTLVNATDGVTLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPTPDPDPTQDPDPTPDPEPTPAYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSSMTGTRADNQNHGYAVGLTSSWFQHGKQKQGAWLDNWLQYAWFSNDVSEHEDGVDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDASTISDDAVKQRGEIKVGVTGNISQRVSLRGSVAWQKGSDDFAQTAGFLSMTVKW

SEQ ID NO: 17 - protein, 980 aa, Escherichia coli 0157:H7
MHSWKKKLIVSQLALACTLAITSQANAATNDISGQTYNTFHHYNDATYADDVYYDGYVGWNNYAADSYYNGDIYPVINNATVNGVISTYYLDDGISTNTNANSLTIKNSTIHGMITSECMTTDCADDRATGYVYDRLTLSVDNSTIDDNYEHYTYNGTYNNAADTHVVDVYDMGTAITLDQEVDLSITNNSHVAGITLTQGYEWEDIDDNTVSTGVNSSEVFNNTITVKDSTVTSGSWTDEGTTGWFGHTGNASNYSNTLTADDVAIAAIANPYADNAMQTTVTLDNSTLMGDVVFSSNFDENFFPQGANSYRDADGDVDTNGWDGTDRMDVTLNNGSKWVGAAMSVHMVDEDGDGSYDGYAVGTEATATLLDIAANSLWPSSTVGVDNINTQYDENGHIVGNEVYQSGLFNVTLNGGSEWDTTKSSLIDTLSINSGSQVNVADSRLISDTVSLTGGSNLNIGEDGHVATNTLTIDNSTVKMSDDVSAGWGLEDAALYANTITVTNDGLLDINVDQFDANPFQADTLNLTSTTDTNGNIHAGVFDIHSSDYVMDTDLVNDRTNDTTKSNYGYGLIAMNSDGHLTINGNGDNDNTASIEAGQNEVDNNGDHVAAATGNYKVRIDNATGAGSIADYNGNELIYVNDKNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSISGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 18 - protein, 187 aa, Escherichia coli 0157:H7
MKLKHVGMIVVSVLAMSSAAVSAAEGDESVTTTVNGGVIHFKGEVVNAACAIDSESMNQTVELGQVRSSRLAKAGDLSSAVGFNIKLNDCDTNVSSNAAVAFLGTTVTSNDDTLALQSSAAGSAQNVGIQILDRTGEVLILDGATFSAKTDLIDGTNILPFQARYIALGQSVAGTANADATFKVQYL

SEQ ID NO: 19 - protein, 152 aa, Escherichia coli 0157:H7
MKLLKVAAIAAIVFSGSALAGVVPQYGGGGGNHGGGGNNSGPNSELNIYQYGGGNSALALQADARNSDLTITQHGGGNGADVGQGSDDSSIDLTQRGFGNSATLDQWNGKDSHMTVKQFGGGNGAAVDQTASNSTVNVTQVGFGNNATAHQY

SEQ ID NO: 20 - protein, 558 aa, Escherichia coli 0157:H7
MPIGNLGHNPNVNNSIPPAPPLPSQTDGAGGRGQLINSTGPLGSRALFTPVRNSMADSGDNRASDVPGLPVNPMRLAASEITLNDGFEVLHDHGPLDTLNRQIGSSVFRVETQEDGKHIAVGQRNGVETSVVLSDQEYARLQSIDPEGKDKFVFTGGRGGAGHAMVTVASDITEARQRILELLEPKGTGESKGAGESKGVGELRESNSGAENTTETQTSTSTSSLRSDPKLWLALGTVATGLIGLAATGIVQALALTPEPDSPTTTDPDAAASATETATRDQLTKEAFQNPDNQKVNIDELGNAIPSGVLKDDVVANIEEQAKAAGEEAKQQAIENNAQAQKKYDEQQAKRQEELKVSSGAGYGLSGALILGGGIGVAVTAALHRKNQPVEQTTTTTTTTTTTSARTVENKPANNTPAQGNVDTPGSEDTMESRRSSMASTSSTFFDTSSIGTVQNPYADVKTSLHDSQVPTSNSNTSVQNMGNTDSVVYSTIQHPPRDTTDNGARLLGNPSAGIQSTYARLALSGGLRHDMGGLTGGSNSAVNTSNNPPAPGSHRFV

SEQ ID NO: 21 - protein, 186 aa, Escherichia coli 0157:H7
MFSTFKKAALLAAIALPFSTMAAPTVTFQGEVTDQTCSVNINGQTNSVVLMPTVAMADFGATLADGQSAGQTPFTVSVSNCQAPTGADQAINTTFLGYDVDASTGVMGNRDTSSDAAKGFGIQLMDSSTSGNPVTLAGATNVPGLTLKVGDTEASYDFGARYFVIDSAAATAGKITAVAEYTLSYL

SEQ ID NO: 22 - protein, 466 aa, Escherichia coli 0157:H7
MNSEGGKPGNVLTVNGNYTGNNGLMTFNATLGGDNSPTDKMNVKGDTQGNTRVRVDNIGGVGAQTVNGIELIEVGGNSAGNFALTTGTVEAGAYVYTLAKGKGNDEKNWYLTSKWDGVTPADTPDPINNPPVVDPEGPSVYRPEAGSYISNIAAANSLFSHRLHDRLGEPQYTDSLHSQDSASSMWMRHVGGHERSSAGDGQLNTQANRYVLQLGGDLAQWSSNAQDRWHLGVMAGYANQHSNTQSNRVGYKSDGRISGYSAGLYATWYQNDANKTGAYVDSWALYNWFDNSVSSDNRSADDYDSRGVTASVEGGYTFEAGTCSGSEGTLNTWYVQPQAQITWMGVKDSDHARKDGTRIETEGDGNVQTRLGVKTYLNSHHQRDDGKQREFQPYIEANWINNSKVYAVKMNGQTVSRDGARNLGEVRTGVEAKVNNNLSLWGNVGVQLGDKGYSDTQGMLGVKYSW

SEQ ID NO: 23 - protein, 878 aa, Escherichia coli 0157:H7
MSYLNLRLYQRNTQCLHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLARNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 24 - protein, 326 aa, Escherichia coli 0157:H7
MQIIFGEKCVSLLRLFFAAVLMLWCAQTAAYSGQCHTTQGNPYIGVNFGVKTLEEEENTTGVVKDKFYQWNESNDYYVSCDCDKDNVRSGRWAFAADSPLVYLGDNWYKINDYLAAKVLLQVKGSSPTAVPFENVGTGADTRWHICDPGGQRLGGQGASGNSGSFSLKILQPFVGSVVIPPMALARLFECYNIPAGDSCTTTGTPVLVYYLSGTINSLGSCSVNAGETIEVDLGDVFAANFRVVGHKPLGARTAELAIPVRCNTGNAGLVNVNLSLTATTDPSYPQAIKTSRPGVGVVVTDSQNNIISPAGGTLPLSIPDDADSIA

SEQ ID NO: 25 - protein, 182 aa, Escherichia coli 0157:H7
MKIKTLAIVVLSALSLSSTAALAAATTVNGGTVHFKGEVVNAACAVDAGSVDQTVQLGQVRTASLAQDGATSSAVGFNIQLNDCDTNVASKAAVAFLGTVIDAGHTNVLALQSSAAGSATNVGVQILDRTGAALTLDGATFSEQTTLNNGTNTIPFQARYYAIGEATPGAANADATFKVQYQ

SEQ ID NO: 26 - protein, 201 aa, Escherichia coli 0157:H7
MKLKVIATLIATVAVGVSFNSNFASASTTSASLTVNSNLTMGTCSAQIMDNSNKVINEVVFGNVYISELGAKSKVQQFKIRFSNCSGLPQNSAQIVLAPNGISCAGSQSSSAGFSNKFTDASAATRTAVEVWTTDTPESNGSTQFHCAQKIPVPVTLPADTTTQPYDYPLSARMTVAEGRLVTDVRPGNFRSPTTFTITYQ

SEQ ID NO: 27 - protein, 836 aa, Escherichia coli 0157:H7
MASTVEYGETVDGVVLEKDIQLVYGTANNTKINPGGEQHIKEFGISSNTEINGGYQYIEMNGTAEYSVLNDGYQIVQMGGAANQTTLNNGVLQVYGAANDPTIKGGRLIVEKDGITVLAAIEKGGLLEVKEGGLAIAVDQKAGGAIKASTRVMEVFGTNRLGQFEIKNGIANNMLLENGGSLRVEENDFAYNTTVDSGGLLEVMDGGTATGVDKKAGGKLIVSTNALEVSGTNSKGQFSIKDGVSKNYELDDGSGLIVMEDTQAIDTILDEHATMQSLGKDTGTRVQANAVYDLGRSDQNGSITYSSKAISENMVINNGRANVWAGTMVNVSVRGNDGILEVMKPQINYAPAMLVGKVVVSEGASLRTHGAVDTSKADVSLENSAWTIIADITTTNQNTRLNLANLAMSGANVIMMDESVTRSSVTASAENFTTLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTAMWSSAINTRNNVTTDAGAGFEQTLTGLTLGIDSRFSREESSTIRGLFFGYSHSDIGFDRGGKGNVDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNQVKVNDDGKFNNDVAGTRGVYQAGIRSSFTPTLSGHLSVSYGNGAGVESPWNTQAGVVWTF

SEQ ID NO: 28 - protein, 369 aa, Escherichia coli 0157:H7
MQRKGNKLLIQLCSVILLFFTTSWYALANECYIERNAEGDYHMKISSTQLSLASQMVEVPTEIAEATWDVNIQLRGDAIGCKSLGDSKAVHFLNTADPSLISTYTTTNGAALLKTTVPGIVYSVELLCLSCGAADELDLWLPAQSGADNFIPSTQTKWAYEYSDQSWYLRFRLFITPEFKPKNGVSSGTTIAGKIASWYIGTNDQPWINFYIDNDSLKFFVDEPTCATVALAQDQGNVSGNQVTLGNSYVSEVKNGLTREIPFSIRAEYCYASKITVKLKAANKPSDATLVGKTTGSASGVAVKVNSTYDNSKVLLKADGSNTVDYNFAAWSNNLLFLPFTAQLVPDGSGNAVGVGTFSGNATFSFTYE

SEQ ID NO: 29 - protein, 866 aa, Escherichia coli 0157:H7
MYQFTHQKSRIPKKTLLAACCALFYSSNGAAADTVEYDSSFLMGTGASTIDVKRYAQGNPTPPGLYNVRVFVNGQATSSLEIPFVDIGENSAAACLTHKNLAQLHIKQPEQPVTLLAREGEEEDCLDLAKSYEKADVCFDGSDQFLDLTIPQAYVLKSYGGYVDPSLWESGINAATLAYTLNAYHTSSDNDNSDSVYGAFNSGINLGAWHFRARGNYNWTTDNGSDFDFQDRYLQRDIPAIRSQIIMGDAYTTGETFDSVNVRGVRLYSDSRMLPSALASYAPTIRGVANSNAKVTVTQSGYKIYETTVPPGEFVIDDISPSGFGSELVVTIEEADGSKRTFTQPFSSVVQMQRPGVGRWDFSAGKVIDDSLRSEPNMGQASYYYGLNNLFTGYTGIQFTDNNYLAGLLGVGINTSIGAFAVDVTHSRAEIPDDKTYQGQSYRVTWNKLFQDTGTSFNLAAYRYSTQDYLGLHDALVLIDDAKHLSADEDKNTMQTYSRMKNQFTVSINQPLNIAYEDYGSLFISGSWTYYWAANNSRTEYNVGYSKSVSWGSFSVNLQRSWNEDGEKDDAMYVSVSVPIENILGGKRKSSGFRNLNTQLNTDFDGSHQLNVNSSGNTENNLVNYSVNAGYSLDKNAGDLASVGGYLNYESGLGGISASASATSDNSQQYSISTDGGFVLHSGGLTFTNNSFSSNDTLVLINALGAKGARINNSNNEIDRWGYAVTSSVSPYRENRVGLNIETLENDVELKSTSATTVPRSGSVVLTRFETDEGRSAVLNITAANGKSIPFAAEVYQGEVMIGSMGQGGQAFVRGINDSGELIVRWYENNQTIDCKLHYQFPAQPQTQGSTNTLLLNNLTCQVANH

SEQ ID NO: 30 - protein, 176 aa, Escherichia coli 0157:H7
MKFKRLLHSGIASLSLVACGVNAATDLGPAGDIHFSITITTKACEMEKSDLEVDMGTMTLQKPAAVGTVLSKKDFTIELKECDGISKATVEMDSQSDSDDDSMFALEAGGATGVALKIEDDKGTQQVPKGSSGTPIEWAIDGETTSLHYQASYVVVNTQATGGTANALVNFSITYE

SEQ ID NO: 31 - protein, 176 aa, Escherichia coli 0157:H7
MKYNNIIFLGLCLGLTTYSALSADSVIKISGRVLDYGCTVSSDSLNFTVDLQKNSARQFPTTGSTSPAVPFQITLSECSKGTTGVRVAFNGIEDAENNTLLKLDEGSNTASGLGIEILDGNMRPVKLNDLHAGMQWIPLVPEQNNILPYSARLKSTQKSVNPGLVRASATFTLEFQ

SEQ ID NO: 32 - protein, 167 aa, Escherichia coli 0157:H7
MKWRKRGYLLAAILALASATIQAADVTITVNGKVVAKPCTVSTTNATVDLGDLYSFSLMSAGAASAWHDVALELTNCPVGTSRVTASFSGAADSTGYYKNQGTAQNIQLELQDDSGNTLNTGATKTVQVDDSSQSAHFPLQVRALTVNGGATQGTIQAVISITYTYS

SEQ ID NO: 33 - protein, 117 aa, Escherichia coli 0157:H7
MKRAPLITGLLLISTSCAYASSEGCGADSTSGATNYSSVVDDVTVNQTDNVTGREFTSATLSSTNWQYACSCSAGKAVKLVYMVSPVLTTTGHQTGYYKLNDSLDIKTMNRPGNPGD

SEQ ID NO: 34 - protein, 198 aa, Escherichia coli 0157:H7
MKKALLAAALVMASGSALAVDGGHIDFNGMVQSGTCKVGVVDTGMHSVTTDGVVTLDTANVTDTFAEVSATAVGLLPKEFMISVECDPGAPKNAELTMGSASYANTSGTLNNNMNITVNGIAPAQNVNIAVHNMKNKAGAAEIKQVHMNNSSEVQELTLDAEGKGQYVFNASYVKAPNSPAVTAGHVTTNALYTVAYK

SEQ ID NO: 35 - protein, 200 aa, Escherichia coli 0157:H7
MKPNMIVGALALTSVFMAGHLQAADGTVHFRGEIIDSTCEVTPETKDQVVDLGKVNRTAFSGVDDVAAPTAFSIDLTQCPETFKSAAIRFDGNEDAHGNGNLAIGTPLDNSNDAAAGISPSDNSGDYTGAGAVSAAKGVAIRLYNRADNTQVKLYENSASTPISNGNASMKFMARYIATETTIDPGTANADSQFTVEYIK

SEQ ID NO: 36 - protein, 485 aa, Escherichia coli 0157:H7
MPIFQREGHLKYSFAAGEYQAGNYDSASPRFGQLDLIYGLPWGMTAYGGVLISNNYNAFTLGIGKNFGYIGAISIDVTQAKSELNNDRDSQGQSYRFLYSKSFESGTDFRLAGYRYSTSGFYTFQEATDVRSDADSDYNRYHKRSEIQGNLTQQLGAYGSVYLNLTQQDYWNDAGKQNTVSAGYNGRIGKVSYSIAYSWNKSPEWDESDRLWSFNISVPLGRAWSNYRVTTDQDGRTNQQVGVSGTLLEDRNLSYSVQEGYASNGVGNSGNANVGYQGGSGNVNVGYSYGKDYRQLNYSVRGGVIVHSEGVTLSQPLGETMTLISVPGARNARVVNNGGVQVDWMGNAIVPYAMPYRENEISLRSDSLGDDVDVENAFQKVVPTRGAIVRARFDTRVGYRVLMTLLRSAGSPVPFGATATLITDKQNEVSSIVGEEGQLYISGMPEEGRVLIKWGNDASQQCVAPYKLSLELKQGGIIPVSANCQ

SEQ ID NO: 37 - protein, 382 aa, Escherichia coli 0157:H7
MSGYTVKPPTGDSNEQTQFIDYFNLFYSKRDQEQISISQQLGNYGATFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 38 - protein, 238 aa, Escherichia coli 0157:H7
MSALYERSQLTQVMISSAPATAETMEKAEYLRLDCTIKEVQFTAGQKQDIDVTTLCSTEQENINGLGASSEISMSGNFYLNQAQNALRDAYDNDTVYAFKVQFPSGKGFKFLAEVRQHTWSSGTNGVVAATFSLRLKGKPVSYVVPLAFVKNLDKTLTVNTGALLTMSVSVNGGTPPYKHAWKKDGQPVEGQTTDTFSKPGAQSGDKGAYTCEVTDSAEQPQSITSDACTVTVNGAGG

SEQ ID NO: 39 - protein, 176 aa, Escherichia coli 0157:H7
MRNKPFYLLCAFLWLAVSHALAADSTITIRGYVRDNGCSVAAESTNFTVDLMENAAKQFNNIGATTPVVPFRILLSPCGNAVSAVKVGFTGVADSHNANLLALENTVSAASGLGIQLLNEQQNQIPLNAPSSAISWTTLTPGKPNTLNFYARLMATQVPVTAGHINATATFTLEYQ

SEQ ID NO: 40 - protein, 840 aa, Escherichia coli 0157:H7
MNKSVVSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGITFGPYLGETFALVEAKGAEGAKVYNSSQLEINDSGYALVPAVTPYRYNRISLDPQGMDGDAELVDSERQVAPVAGAAVKVIFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 41 - protein, 676 aa, Escherichia coli 0157:H7
MKLAACFLTLLPGFAVAASWTSPGFPAFSEQGTGTFVSHAQLPKGTRPLTLNFDQQCWQPADAIKLNQMLSLQPCSNTPPQWRLFRDGKYTLQIDTRSGTPTLMISIQNAAEPVANLVRECPKWDGLPLTLDVSATFPEGAAVRDYYSQQIAIVKNGQITLQPAATSNGLLLLERAETDASAPFDWHNATVYFVLTDRFENGDPSNDQSYGRHKDGMAEIGTFHGGDLRGLTNKLDYLQQLGVNALWISAPFEQIHGWVGGGTKGDFPHYAYHGYYTQDWTNLDANMGNEADLRTLVDSAHQRGIRILFDVVMNHTGYATLADMQEYQFGALYLSGDEVKKTLGERWSDWKPAAGQTWHSFNDYINFSDKTGWDKWWGKNWIRTDIGDYDNPGFDDLTMSLAFLPDIKTESTTASGLPVFYKNKTDTHAKAIDGFTPRDYLTHWLSQWVRDYGIDGFRVDTAKHVELPAWQQLKTEASAALREWKKANPDKALDDKPFWMTGEAWGHGVMQSDYYRHGFDAMINFDYQEQAAKAVDCIAQMDTTWQQMAEKLQGFNVLSYLSSHDTRLFREGGDKAAELLLLAPGAVQIFYGDESSRPFGPTGSDPLQGTRSDMNWQDVSGKSAANVAHWQKISQFRARHPAIGAGKQTTLSLKQGYGFVREHGDDKVLVIWAGQQ

SEQ ID NO: 42 - protein, 838 aa, Escherichia coli 0157:H7
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYNFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 43 - protein, 344 aa, Escherichia coli 0157:H7
MMFRNRILLIFILWANFTWAGCRTTASLNITDGINVGEILANETSFSKSVVFTGISCDTSTDKIVYKNIQSDWVEVGPFGNGEKLKVKIESLGKTSDTIGKSSNAQAVLPYVVKIARGTPDFTGERKSTWFISDTVIANIGGESSSSIDFWLGICKALKFNWCVNYLTSKLAGDTFTLGLNISYYPKNTTCKPENTVIKVDDIALFQLRNQGKIAANSKEGTITLKCDNLFGDKKQASRNMVVYLSSSDLVKGSNTILRGKTDNGVGFVLDLTEPPKGTEAAIKISANGDQGAATSLWKTDKPGVSLNSNIINIPVMASYYVYDEKKVKSGALEATALINVKYD

SEQ ID NO: 44 - protein, 614 aa, Escherichia coli 0157:H7
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGGSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNIIIGHGNVGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 45 - protein, 151 aa, Escherichia coli 0157:H7
MKNKLLFMMLTILGAPGIAAAAGYDLANSEYNFAVNELSKSSFNQAAIIGQAGTNNSAQLRQGGSKLLAVVAQEGSSNRAKIDQTGDYNLAYIDQAGSANDASISQGAYGNTAMIIQKGSGNKANITQYGTQKTAIVVQRQSQMAIRVTQR

SEQ ID NO: 46 - protein, 233 aa, Escherichia coli 0157:H7
MNIFAYLLVLVFSMSMSSSAFASVVMTGTRIIFPGDAKEKTIQLRNTSDQPYIINIHVEDERGSDKNVPFMPTPQTFRMEAAAGQALRLLYTGNNLPQDRESVFWFSFSQLPYLNKNDKSQNQLILALTNRVKIFYRPSSIVGKSSDAPKNLTYQVKQNRIEVTNPTGYYVTIRAAELLNNGKKVPLANSVMIAPQSTTEWTLPSGISVAPGAQIHLVTVNDYGVNVTSEHAL

SEQ ID NO: 47 - protein, 167 aa, Escherichia coli 0157:H7
MKRLHKRFLLATFCALLTATLQAADVTITVNGRVVAKPCTIQTKEANVNLGDLYTRNLQQPGSASGWHNITLSLTDCPAETSAVTAIVTGSTDNTGYYKNEGTAENIQIELRDDQDATLKNGDSKTVIVDEITRNAQFPLKARAITVNGNASQGTIEALINVIYTWQ

SEQ ID NO: 48 - protein, 317 aa, Escherichia coli 0157:H7
MRAKLLGIVLTTPIAISSFASTETLSFTPDNINADISLGTLSGKTKERVYLAEEGGRKVSQLDWKFNNAAIIKGAINWDLMPQISIGAAGWTTLGSRGGNMVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKMPYIGLTGSYRYEDFELGGTFKYSGWVEASDNDEHYDPGKRITYRSKVKDQNYYSVSVNAGYYVTPNAKVYVEGTWNRVTNKKGNTSLYDHNDNTSDYSKNGAGIENYNFITTAGLKYTF

SEQ ID NO: 49 - protein, 259 aa, Escherichia coli 0157:H7
MFFKRGKILSAGRLNKKSLGIVMLLSVGLLLAGCSGSKSSDTGTYSGSVYTVKRGDTLYRISRTTGTSVKELARLNGISPPYTIEVGQKLKLGGAKSSSSTRKSTAKSTTKTASVTPSSAVPKSSWPPVGQRCWLWPTTGKVIMPYSTADGGNKGIDISAPRGTPIYAAGAGKVVYVGNQLRGYGNLIMIKHSEDYITAYAHNDTMLVNNGQSVKAGQKIATMGSTDAASVRLHFQIRYRATAIDPLRYLPPQGSKPKC

SEQ ID NO: 50 - protein, 246 aa, Escherichia coli 0157:H7
MPTPNPLAPVKGAGTTLWVYNGNGDPYANPLSDNDWSRLAKVKDLTPGELTAESYDDSYLDDEDADWAATGQGQKSAGDTSFTLAWMPGEQGQQALLAWFNEGDTRAYKIRFPNGTVDVFRGWVSSIGKAVTAKEVITRTVKVTNVGRPSMAEDRSTVTAATGMTVTPASTSVVKGQSTTLTVAFQPEGATDKSFRAVSADKTKATVSVSGMTITVKGVAAGKVNIPVVSGNGEFAAVAEINVTAS

SEQ ID NO: 51 - protein, 238 aa, Escherichia coli 0157:H7
MSALYERSQLTQVMISSAPATAETMDKAEYLRLDCTIKEVQFTAGQKQDIDVTTLCSTEQENINGLGASSEISMSGNFYLNQAQNALRDAYDNDALYAFKVLFPSGKGFKFLAEVRQHTWSSGTNGVVAATFSLRLKGKPVSFVVPLAFVKNLDKTLTVNTGALLTMSVSANGGTPPYKYAWKKDGQPVDGQTTDTFSKPGAQSADAGKYTCVVTDSAEKAQSVTSVECTVTVSAAAG

SEQ ID NO: 52 - protein, 238 aa, Escherichia coli 0157:H7; identical to SEQ ID NO: 51

SEQ ID NO: 53 - protein, 138 aa, Escherichia coli 0157:H7
MRVKHAVVLLMLISPLSWAGTMTFQFRNPNFGGNPNNGAFLLNSAQAQNSYKDPSYNDDFGIETPSALDNFTQAIQSQILGGLLSNINTGKPGRMVTNDYIVDIANRDGQLQLNVTDRKTGQTSTIQVSGLQNNSTDF

SEQ ID NO: 54 - protein, 214 aa, Escherichia coli 0157:H7
MKRKVLAMLVPALLVAGAANAAEIYNKDGNKLDLYGKVAGLHYFSDDASSDGDMSYARIGFKGETQIADQFTGYGQWEFNIGANGPESDKGNTATRLAFAGFGFGQNGTFDYGRNYGVVYDVEAWTDMLPEFGGDTYAGADNFMNGRANSVATYRNNGFFGQVDGLNFALQYQGNNEKSGLFDQEGSGNGNGRKLAKENGDGSVCPLPMTLTLV

SEQ ID NO: 55 - protein, 807 aa, Escherichia coli 0157:H7
MNTVTLEGGTFNNNGTLNDVVKIEKNSNAVINNTGSLSTLQLHDGTVNNSGIASARVNAQGDAVFNNLAGGEARKGAILYNSAVVNNAGTWKMGYQDENNNAGTLDIDDKSTFNNSGKLILDNSKNAIRFQGSNANATLYNTGEMTLDAALGAGAILYDDGASEFINKGVVDAKVTVAVSTAGATESDAFLWNQDGGVINFDKDNASAVKFTHNNYVALNDGVMNISGNNAVAMEGDKNAQLVNNGVINLGTEGTTDTGLTGMQLDANATADAVIENNGTINIFANDSFAFSVLGTEGHIVNNGTVVIADGVTGSGLIKQGDSVNVEGVNGNSGNNTEVHYTDYTLPDMPNTYTTSPFSETTDSGSSDGSSNNLNGYIVGTNVDGSAGKLKVNNASMNGVGINTGFAAGTADTTVSFDNVVEGINLTDADAITSTSVVWTAKGSTDASGNVDVIMSKNAYTDVATDASVNDVAKALDAGYTNNELYTSLNVGTTAELNSALKQVSGSQATTVFREARVLSNRFSMLADAAPKVGNGLAFNVVAKGDPRAELGNNTEYDMLALRKTVDLSESQSMSLEYGIARLDGDGAQKAGDNGVTGGYSQFFGLKHQMSFDNGMRWNNALRYDVHNLDSSRSVAYGDVSKTADTDVKQQYLELRSEGAKTFEPREGLKITPYAGVKLRHSLEGGYQERNAGDFNLSMNSGSETAVDSIVGLKLDYAGKGGWSANATLEGGPNLSYSKSQRTASLAGAGSQHFNVDDGQKGGGINSLASVGVKYSSKESSLNLDAYHWKEDGISDKGVMLNFKKTF

SEQ ID NO: 56 - protein, 248 aa, Escherichia coli 0157:H7
MLNGISNAASTLGRQLVGIASRVSSAGGTGFSVAPQAVRLTPVKVHSPFSPGSSNVNARTIFNVSSQVTSFTPSRPAPPPPTSGQASGASRPLPPIAQALKEHLAAYEKSKGPEALGFKPARQAPPPPTSGQASGASRPLPPIAQALKEHLAAYEKSKGPEALGFKPARQAPPPPTSGQASGASRPLPPIAQALKEHLAAYEKSKGPEALGFKPARQAPPPPTGPSGLPPLAQALKDHLAAYEQSKKG

SEQ ID NO: 57 - protein, 746 aa, Escherichia coli 0157:H7
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDNDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 58 - protein, 131 aa, Escherichia coli 0157:H7
MGGRFSLRYKKLSYRFVFLTLAGCSSVGNQSLKNETQESVKTKIVKGKTTKQDVLASFGEPDSRSLIDGEEQWSYTMYNSQSKATSFIPVVGLLAGGADSQTKSLTVSFKGEKVSTYIFNAGTSNVKTGIF

SEQ ID NO: 59 - protein, 171 aa, Escherichia coli 0157:H7
MKKIACLSALAAVLAFTAGTSVAATSTVTGGYAQSDAQGQMNKMGGFNLKYRYEEDNSPLGVIGSFTYTEKSRTASSGDYNKNQYYGITAGPAYRINDWASIYGVVGVGYGKFQTTEYPTYKHDTSDYGFSYGAGLQFNPMENVALDFSYEQSRIRSVDVGTWIAGVGYRF

SEQ ID NO: 60 - protein, 244 aa, Escherichia coli 0157:H7
MKSIATLVVCAISGIACVNLSAHAAEGEHTISLGYAHFQFPGLKDFVKDATAHNRETFSHFVNRNYFSSLGEYTDGRVSGYEGKDKNPQGINIRYRYEITDDFGVITSFTWTRSLTNSQTFIDVQSADHTRKIKNPAASARTDIRANYWSLLAGPSWRVNQYMSLYAMAGMGVAKVSADLKIKDNINSSGGFSESNSTKKTSLAWAAGAQFNLNESVTLDVAYEGSGSGDWRTSGVTAGIGLKF

SEQ ID NO: 61 - protein, 199 aa, Escherichia coli 0157:H7
MRKLYAAILSAAICLTVSGAPAWASEQQATLSAGYLHVSTNAPGSDNLNGINVKYRYEFTDTLGLVTSFSYAGDRNRQITRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 62 - protein, 199 aa, Escherichia coli 0157:H7
MRKLYAAILSAAICLAVSGAPAWASEQQATLSAGYLHARTSAPGSDNLNGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 63 - protein, 199 aa, Escherichia coli 0157:H7; identical to SEQ ID NO: 62

SEQ ID NO: 64 - protein, 199 aa, Escherichia coli 0157:H7; identical to SEQ ID NO: 62

SEQ ID NO: 65 - protein, 448 aa, Escherichia coli 0157:H7
MVMSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGKTPQGQALAATANGIDSNTKIAHLNGNQWGFGWNAGILYELDKNNRYALTYRSEVKIDFKGNYSSDLNRVFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 66 - protein, 401 aa, Escherichia coli 0157:H7
MAFSQAVSGLNAAATNLDVIGNNIANSATYGFKSGTASFADMFAGSKVGLGVKVAGITQDFTDGTTTNTGRGLDVAISQNGFFRLVDSNGSVFYSRNGQFKLDENRNLVNMQGLQLTGYPATGTPPTIQQGANPTNISIPNTLMAAKTTTTASMQINLNSSDPLPSVNAFDASNADSYNKKGSVTVFDSQGNAHDMSVYFVKTGDNNWQVYTQDSSDPTGTAEPAMKLVFNANGVLTSNPTENITTGAINGAEPATFSLSFLNSMQQNTGANNIVATTQNGYKPGDLVSYQINDDGTVVGNYSNEQTQLLGQIVLANFANNEGLASEGDNVWSATQSSGVALLGTAGTGNFGTLTNGALEASNVDLSKELVNMIVAQRNYQSNAQTIKTQDQILNTLVNLR

SEQ ID NO: 67 - protein, 444 aa, Escherichia coli 0157:H7
MSKSTFLHILISSIILVALIQSSAWANCTNTQIGQTEDGRTALIEFGKINMTDTYFAPAGSLLATTVVPPTNYTSGGATGSSVLWECDATDLPNIYFLVATNGDDRVGGFYDAGGPDGLSDVYATWFAFVGLKQTMAGVTLGRYWKKVPITSYATQGTKIQIRLQDIPPLHAELYRISTLPDTSATTSWCGNNNTDSSGVGFAKPSGTIYNCVQPNAYIQLSGTSGILFGHDEPGEDSSVHWDFWGADNGFGYGMRSANRLYNNATCVARSATPLVLLPTIAEAQLNAGMESTGNFNVRVECSNSVQSGISDTQTALGIQVSEGAYTAAQKLGIINSNGGVSALVSDNYDAAEMAKGVGIYISNSAHPDTAMTLVGQPGIAKLTPGGNAAGWYPVFEGATLEGATHPGYSSYSYSFIARLKKLPNQTVSAGKVRATAYILVKMQ

SEQ ID NO: 68 - protein, 760 aa, Escherichia coli 0157:H7
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTASIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 69 - protein, 495 aa, Escherichia coli 0157:H7
MQMKKLLPILIGLSLSGFSSLSQAENLMQVYQQARLSNPELRKSAADRDAAFEKINEARSPLLPQLGLGADYTYSNGYRDANGINSNATSASLQLTQSIFDMSKWRALTLQEKAAGIQDVTYQTDQQTLILNTATAYFNVLNAIDVLSYTQAQKEAIYRQLDQTTQRFNVGLVAITDVQNARAQYDTVLANEVTARNNLDNAVEQLRQITGNYYPELAALNVENFKTDKPQPVNALLKEAEKRNLSLLQARLSQDLAREQIRQAQDGHLPTLDLTASSGISDTSYSGSKTRGAAGTQYDDSNMGQNKVGLSFSLPIYQGGMVNSQVKQAQYNFVGASEQLESAHRSVVQTVRSSFNNINASISSINAYKQAVVSAQSSLDAMEAGYSVGTRTIVDVLDATTTLYNAKQELANARYNYLINQLNIKSALGTLNEQDLLALNNALSKPVSTNPENVAPQTPEQNAIADGYAPDSPAPVVQQTSARTTTSNGHNPFRN

SEQ ID NO: 70 - protein, 248 aa, Escherichia coli 0157:H7
MTKLKLLALGVLIATSAGVAHAEGKFSLGAGVGVVEHPYKDYDTDVYPVPVINYEGDNFWFRGLGGGYYLWNDATDKLSITAYWSPLYFKAKDSGDHQMRHLDDRKSTMMAGLSYAHFTQYGYLRTTLAGDTLDNSNGIVWDMAWLYRYTNGGLTVTPGIGVQWNSENQNEYYYGVSRKESARSGLRGYNSNDSWSPYLELSASYNFLGDWSVYGTARYTRLSDEVTDSPIVDKSWTGLISTGITYKF

SEQ ID NO: 71 - protein, 294 aa, Escherichia coli 0157:H7
MKKTLLAAGAVLALSSSFTVNAAENDKPQYLSDWWHQSVNVVGSYHTRFGPQIRNDTYLEYEAFAKKDWFDFYGYADAPVFFGGNSDAKGIWNHGSPLFMEIEPRFSIDKLTNTDLSFGPFKEWYFANNYIYDMGRNKDGRQSTWYMGLGTDIDTGLPMSLSMNVYAKYQWQNYGAANENEWDGYRFKIKYFVPITDLWGGQLSYIGFTNFDWGSDLGDDSGNAINGIKTRTNNSIASSHILALNYDHWHYSVVARYWHDGGQWNDDAELNFGNGNFNVRSTGWGGYLVVGYNF

SEQ ID NO: 72 - protein, 729 aa, Escherichia coli 0157:H7
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 73 - protein, 451 aa, Escherichia coli 0157:H7
MARFQFKNRKNNGLIFFISFMVMGEAAIAAPLPQWANAPAVTPVAQLSLQESILRAFARNPGVTQQAAQIGIGEAQIDEAKSAWYPHVGLTGNAGPSRQTDSSGRLDNNVSYGITLTQLVYDFGKTNNDINLQTAARDSYRFKLMATLTDVAEKTATAYMEVSRYQALCDAAQRNIHSLENVYNMAALRANAGLNSSSDELQAQTRIAGMRSTLEQYQAQMASAKAQLAVLTGVQPEAIAAPPAELAEQPVSLKNIDYQSIPLVLAAENLRQSAQYGVEKTKAQYWPTLSIQGGKTRYQTSDRSYWDDQLQLNVNAPLYQGGAVSAQVQQAEGQQKISASQVEQAKLDVLQRASVAYANWTGARGREEAGLAQSESAHKTRDVYQNEYKLGKRSLNDLLTVEQDVFQAQSAEINANYDGWVAAVNYAAAVNNLIPLAGIKQGLYNDLPDLK

SEQ ID NO: 74 - protein, 713 aa, Escherichia coli 0157:H7
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHCVSRRSATNGADYYLPGYFVADAFAAYKMKLQYPVTLQLNVKNLFDKTYYTSSIATNNLGNQIGDPREVQFTVKMEF

SEQ ID NO: 75 - protein, 289 aa, Escherichia coli 0157:H7
MRTLQGWLLPVFMLPMAVYAQEATVKEVHDAPAVRGSIIANMLQEHDNPFTLYPYDTNYLIYTQTSDLNKEAIASYDWAENARKDEVKFQLSLAFPLWRGILGPNSVLGASYTQKSWWQLSNSEESSPFRETNYEPQLFLGFATDYRFAGWTLRDVEMGYNHDSNGRSDPTSRSWNRLYTRLMAENGNWLVEVKPWYVVGNTDDNPDITKYMGYYQLKIGYHLGDAVLSAKGQYNWNTGYGGAELGLSYPITKHVRLYTQVYSGYGESLIDYNFNQTRVGVGVMLNDLF

SEQ ID NO: 76 - protein, 193 aa, Escherichia coli 0157:H7
MAVQKNVIKGILAGTFALMLSGCVTVPDAIKGSSPTPQQDLVRVMSAPQLYVGQEARFGGKVVAVQNQQGKTRLEIATVPLDSGARPTLGEPSRGRIYADVNGFLDPVDFRGQLVTVVGPITGAVDGKIGNTPYKFMVMQATGYKRWHLTQQVIMPPQPIDPWFYGGRGWPYGHGGWGWYNPGPARVQTVVTE

SEQ ID NO: 77 - protein, 362 aa, Escherichia coli 0157:H7
MRKQWLGICIAAGMLAACTSDDGQQQTVSVPQPAVCNGPIVEISGADPRFEPLNATANQDYQRDGKSYKIVQDPSRFIQAGLAAIYDAEPGSNLTASGEAFDPTQLTAAHPTLPIPSYARITNLANGRMIVVRINDRGPYGNDRVISLSRAAADRLNTSNNTKVRIDPIIVAQDGSLSGPGMACTTVAKQTYALPAPPDLSGGAGTSSVSGPQGDILPVSNSTLKSEDPTGAPVTSSGFLGAPTTLAPGVLEGSEPTPAPQPVVTAPSTTPATSPAMVTPQAASQSASGNFMVQVGAVSDQARAQQYQQQLGQKFGVPGRVTQNGAVWRIQLGPFANKAEASTLQQRLQTEAQLQSFITTAQ

SEQ ID NO: 78 - protein, 155 aa, Escherichia coli 0157:H7
MIKRVLVVSMVGLSLVGCVNNDTLSGDVYTASEAKQVQNVSYGTIVNVRPVQIQGGDDSNVIGAIGGAVLGGFLGNTVGGGTGRSLATAAGAVAGGVAGQGVQSAMNKTQGVELEIRKDDGNTIMVVQKQGNTRFSPGQRVVLASNGSQVTVSPR

SEQ ID NO: 79 - protein, 394 aa, Escherichia coli 0157:H7
MSKATEQNDKLKRAIIISAVLHVILFAALIWSSFDENIEASAGGGGGSSIDAVMVDSGAVVEQYKRMQSQESSAKRSDEQRKMKEQQAAEELREKQAAEQERLKQLEKERLAAQEQKKQAEEAAKQAELKQKQAEEAAAKAAADAKAKAEADDKAAEEAAKKAAADAKKKAEAEAAKAAAEAQKKAEAAAAALKKKAEAAEAAAAEARKKAAAEKAAADKKAAEKAAAEKAAADKKAAAEKAAADKKAAAAKAAAEKAAAAKAAAEADDIFGELSSGKNAPKTGGGAKGNNASPAGSGNTKNNGASGADINNYAGQIKSAIESKFYDASSYAGKTCTLRIKLAPDGMLLDIKPEGGDPALCQAALAAAKLAKIPKPPSQAVYEVFKNAPLDFKP

SEQ ID NO: 80 - protein, 172 aa, Escherichia coli 0157:H7
MMKFKKCLLPVAMLASFTLAGCQSNADDHAADVYQTDQLNTKQETKTVNIISILPAKVAVDNSQNKRNAQAFGALIGAVAGGVIGHNVGSGSNSGTTAGAVGGGAVGAAAGSMVNDKTLVEGVSLTYKEGTKVYTSTQVGKECQFTTGLAVVITTTYNETRIQPNTKCPEKS

SEQ ID NO: 81 - protein, 248 aa, Escherichia coli 0157:H7
MLLSIITVAFRNLEGIVKTHASLAHLAQAEDISFEWIVVDGGSNDGTREYLENLNGIYNLRFVSEPDNGIYDAMNKGIAMAQGKFALFLNSGDIFHQDAAYFVRKLKMQKDNVMITGDALLDFGDGHKIKRSAKPGWYIYHSLPASHQAIFFPVSGLKKWRYDLEYKVSSDYALAAKMYKAGYAFKKLNGLVSEFSMGGVSTTNNMELCADAKKVQRQILHVPGFWAELSWHLRQRTTSKTKALYNKS

SEQ ID NO: 82 - protein, 149 aa, Haemophilus influenzae Rd
MKLTTLQTLKKGFTLIELMIVIAIIAILATIAIPSYQNYTKKAAVSELLQASAPYKADVELCVYSTNETTSCTGGKNGIAADIKTAKGYVASVITQSGGITVKGNGTLANMEYILQAKGNAAAGVTWTTTCKGTDASLFPANFCGSVTK

SEQ ID NO: 83 - protein, 1694 aa, Haemophilus influenzae Rd
MLNKKFKLNFIALTVAYALTPYTEAALVRDDVDYQIFRDFAENKGRFSVGATNVEVRDKNNHSLGNVLPNGIPMIDFSVVDVDKRIATLINPQYVVGVKHVSNGVSELHFGNLNGNMNNGNAKSHRDVSSEENRYFSVEKNEYPTKLNGKAVTTEDQTQKRREDYYMPRLDKFVTEVAPIEASTASSDAGTYNDQNKYPAFVRLGSGSQFIYKKGDNYSLILNNHEVGGNNLKLVGDAYTYGIAGTPYKVNHENNGLIGFGNSKEEHSDPKGILSQDPLTNYAVLGDSGSPLFVYDREKGKWLFLGSYDFWAGYNKKSWQEWNIYKPEFAKTVLDKDTAGSLTGSNTQYNWNPTGKTSVISNGSESLNVDLFDSSQDTDSKKNNHGKSVTLRGSGTLTLNNNIDQGAGGLFFEGDYEVKGTSDSTTWKGAGVSVADGKTVTWKVHNPKSDRLAKIGKGTLIVEGKGENKGSLKVGDGTVILKQQADANNKVKAFSQVGIVSGRSTVVLNDDKQVDPNSIYFGFRGGRLDANGNNLTFEHIRNIDDGARLVNHNTSKTSTVTITGESLITDPNTITPYNIDAPDEDNPYAFRRIKDGGQLYLNLENYTYYALRKGASTRSELPKNSGESNENWLYMGKTSDEAKRNVMNHINNERMNGFNGYFGEEEGKNNGNLNVTFKGKSEQNRFLLTGGTNLNGDLKVEKGTLFLSGRPTPHARDIAGISSTKKDQHFAENNEVVVEDDWINRNFKATNINVTNNATLYSGRNVANITSNITASDNAKVHIGYKAGDTVCVRSDYTGYVTCTTDKLSDKALNSFNATNVSGNVNLSGNANFVLGKANLFGTISGTGNSQVRLTENSHWHLTGDSNVNQLNLDKGHIHLNAQNDANKVTTYNTLTVNSLSGNGSFYYLTDLSNKQGDKVVVTKSATGNFTLQVADKTGEPTKNELTLFDASNATRNNLNVSLVGNTVDLGAWKYKLRNVNGRYDLYNPEVEKRNQTVDTTNITTPNNIQADVPSVPSNNEEIARVETPVPPPAPATPSETTETVAENSKQESKTVEKNEQDATETTAQNGEVAEEAKPSVKANTQTNEVAQSGSETEETQTTEIKETAKVEKEEKAKVEKDEIQEAPQMASETSPKQAKPAPKEVSTDTKVEETQVQAQPQTQSTTVAAAEATSPNSKPAEETQPSEKTNAEPVTPVVSKNQTENTTDQPTEREKTAKVETEKTQEPPQVASQASPKQEQSETVQPQAVLESENVPTVNNAEEVQAQLQTQTSATVSTKQPAPENSINTGSATAITETAEKSDKPQTETAASTEDASQHKANTVADNSVANNSESSDPKSRRRRSISQPQETSAEETTAASTDETTIADNSKRSKPNRRSRRSVRSEPTVTNGSDRSTVALRDLTSTNTNAVISDAMAKAQFVALNVGKAVSQHISQLEMNNEGQYNVWVSNTSMNENYSSSQYRRFSSKSTQTQLGWDQTISNNVQLGGVFTYVRNSNNFDKASSKNTLAQVNFYSKYYADNHWYLGIDLGYGKFQSNLKTNHNAKFARHTAQFGLTAGKAFNLGNFGITPIVGVRYSYLSNANFALAKDRIKVNPISVKTAFAQVDLSYTYHLGEFSVTPILSARYDTNQGSGKINVNQYDFAYNVENQQQYNAGLKLKYHNVKLSLIGGLTKAKQAEKQKTAELKLSFSF

SEQ ID NO: 84 - protein, 199 aa, Haemophilus influenzae Rd
MALVNKIKTLSSVGILAATLFLAGCQAQSNILAFTPPAPSASMNVNRTAVVSVTTKDSRAIQEIASYTKHGELIKLNASPSVTQLFQQVMQQNLISKGFRVGQLNGSNAWVTVDVREFGTQVEQGNLRYKLNTKIQATVYVQGAKGSYNKSFNVTHSQEGVFNAGNDEIHKVLSQTFNDIVNNIYQDQEVAAAINQYSN

SEQ ID NO: 85 - protein, 203 aa, Haemophilus influenzae Rd
MLCWIGYKNGILPQQNSTLYPWLNPSKCGVIFDGFQLVGDDFNSDQTAENTSPAWQVLYTTHLQSCSPIHSGENFAPIPLYKQLKNQPHLSQDLIKWQENWQACDQLQMNGAVLEQQSLAEISDHQSTLSKHGRYLAQEIEKETGIPTYYYLYRVGGQSLESEKSRCCPSCGANWALKDAIFDTFHFKCDTCRLVSNLSWNFL

SEQ ID NO: 86 - protein, 161 aa, Haemophilus influenzae Rd
MGAFAFASVTNANIYAEGDIGLSQTKANGSNNTRVGPRVSVGYKVGNTRVAGDYTHHGKVDGTKIQGLGASVLYDFDTNSKVQPYVGARVATNQFKYTNRAEQKFKSSSDIKLGYGVVAGAKYKLDGNWYANGGVEYNRLGNFDSTKVNNYGAKVGVGYGF

SEQ ID NO: 87 - protein, 795 aa, Haemophilus influenzae Rd
MKKLLIASLLFGTTTTVFAAPFVAKDIRVDGVQGDLEQQIRASLPVRAGQRVTDNDVANIVRSLFVSGRFDDVKAHQEGDVLVVSVVAKSIISDVKIKGNSIIPTEALKQNLDANGFKVGDVLIREKLNEFAKSVKEHYASVGRYNATVEPIVNTLPNNRAEILIQINEDDKAKLASLTFKGNESVSSSTLQEQMELQPDSWWKLWGNKFEGAQFEKDLQSIRDYYLNNGYAKAQITKTDVQLNDEKTKVNVTIDVNEGLQYDLRSARIIGNLGGMSAELEPLLSALHLNDTFRRSDIADVENAIKAKLGERGYGSATVNSVPDFDDANKTLAITLVVDAGRRLTVRQLRFEGNTVSADSTLRQEMRQQEGTWYNSQLVELGKIRLDRTGFFETVENRIDPINGSNDEVDVVYKVKERNTGSINFGIGYGTESGISYQASVKQDNFLGTGAAVSIAGTKNDYGTSVNLGYTEPYFTKDGVSLGGNVFFENYDNSKSDTSSNYKRTTYGSNVTLGFPVNENNSYYVGLGHTYNKISNFALEYNRNLYIQSMKFKGNGIKTNDFDFSFGWNYNSLNRGYFPTKGVKASLGGRVTIPGSDNKYYKLSADVQGFYPLDRDHLWVVSAKASAGYANGFGNKRLPFYQTYTAGGIGSLRGFAYGSIGPNAIYAEHGNGNGTFKKISSDVIGGNAITTASAELIVPTPFVSDKSQNTVRTSLFVDAASVWNTKWKSDKSGLDNNVLKSLPDYGKSSRIRASTGVGFQWQSPIGPLVFSYAKPIKKYENDDVEQFQFSIGGSF

SEQ ID NO: 88 - protein, 134 aa, Haemophilus influenzae Rd
MLKKTSLIFTALLMTGCVQNANVTTPQAQKMQVEKVDKALQKGEADRYLCQDDRVVRVVHATHKKYKKNLHYVTVTFQGVSEKLTLMISERGKNYANIRWMWQERDDFSTLKTNLGEILATQCVSQTSERLSGQ

SEQ ID NO: 89 - protein, 1010 aa, Haemophilus influenzae Rd
MRIIIIFFMGLNMTNFRLERACLFRYAWANGRCCLCSSTNQPTNQPTNQPTNQPTNQPTNQPTNQNSNVSEQLEQINVSGSTENSDTKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGADSIKNGSGSLGGSVIYKTKDARDYLINKDYYVSYKKGYATENNQSFDTLTLAGRYKKFDVLVVTTSRNGHELENYGYKNYNDKIQGKKREKADPYKIEQDSTLLKLSFNPTENHRFTFAADLYEHRSRGQDLSYTLKYQRSGNETPEVDSRHTNDKTKRRNISFSYENFSQTPFWDTLKLTYSDQRIKTRARTDEYCDAGVRHCEGTDNPTGLKVTNGKITRRDGSDLQFEEKNNTAKSSDKTYDFKKFIDTDKRVIDDKLVLNNPSDTWYDCSIFNCENNAKIKVFKGNNYYGYDGKWKEVDLEIKELNGKKFAKIKDNDRKIKSILPSSPGYLERLWQERDLDTNTQQLNLDLTKDFKIWHIEHNLQYGGSYNTAMKRMVNRAGNDASDVQWWATPTLGEDSWTGKPHTCATTYEWNANLCPRVDPEFSYLLPIKTTGKSVYLFDNFVITDYLSFDLGYRYDNIHYQPKYKHGITPKLPDDIVKGLFIPLPNNSNSDPNKVKENVQQNIDYIAKQNKKYKAHSYSFVSTIDPTSFLRLQLKYSKGFRTPTSDEMYFTFKHPDFTILPNTDLKPEIAKTKEIAFTLHNDDWGFISTSLFKTNYKNFIDLIFKKQETFKVGGSGRGETLPFSLYQNINRDNASLKGIEINSKVFLGKMAKFMDGFNLSYKYTYQKGRMNGNIPMNAIQPRTMVYGLGYDHPNHKFGFDFYTTHVASKNPEDTYNMFYKEENKKDSTIKWRSKSYTILDLIGYVQPIKNLTIRAGVYNLTNRKYITWDSARSIRSFGTSNVIDQSTGLGINRFYAPGRNYKMSVQFEF

SEQ ID NO: 90 - protein, 3194 aa, Helicobacter pylori J99
MTYRNGKIDLKERFSKNRSFKGIKKKIAKKYTIKNSLSIIYSLKTHSNSSLSINKKIFLGLGFVSALSAQSEDYNSSVYWLNSVNENNNNKSYYISPLRTWAGGNRSFTQNYNNSQLYIGTKNASATPNHSSVWFGEKGYIGFITGVFKARDIFITGAVGSGNELKTGGGAILVFESSNELTTNGAYFQNNRAGTQTSWINLISNNSVNLTNTDFGNQTPNGGFNVMGRKITYNGGSVNGGNFGFDNVDSNGATTISGVTFNNNGALTYKGGNGIGGSITFTNSNINHYKLNLNANSVTFNNSTLGSMPNGNANTIGNAYILNANNITFNNLTFNGGWFVFNRSDAHVNFQGTTTINNPTSPFVNMTGKVTINPNAIFNIQNYTPTIGNAYTLFSMKNGNIAYDDVNNLWNIIRLKNTQATKDNSKNATSNNNTHTYYVTYNLGGTLYHFRQIFSPDSIVLQSVYYGANNLYYTNSVNIHDNVFNLKNINDDRADTIFYLNGLNTWNYTQARFAQTYGGKNSALVFNATTPWANGAIPKSNSTVRFGGYEGVNWGKTGYITGTFTADRVYITGNMMSGNGAQTGGGATLNFVGATEINIAGATFKNLKTTSQNSYMTFMALGNGSGSGKINVSQSDFYDWTDGGYDFTGNGVFDSVNFNKAYYKFQGAENSYNFKNTNFLAGNFKFQGKTTIEKSVLNDASYAFDGVNNAFNEDKFNGGSFNFNHAEQTNAFNNNSFSGGSFSFNAKQVDFNGNSFNGGVFNFNNTPKASFTNDTFNVNNQFKINGAQTDFTFSKGVVFNMQGLLSSLSVGTTYQLLNAKSVGYKDNNNALYQMLRWTSGENPSGKLVDENKTAPNSAKIYNVQFTDNGLTYYIKENFNNGITLTRLCTLGYTHCVNIDNDAFNLKNVNNNASNTVFYLNGMTTWKTAGTGVFTQDYSGTNSVLVFNQTTPFLAGANPTSNSVVGFGKTSGAEWGLVGYIQGVFKANQIDITGTIRSGNGAKTGGGATLVFNAQERLNIANANLNNDKAGLQNSWMNFIVNNGNLNVTNANFSNQTPHGGFNLKANNITWDKGSVSGGGNFGVDNANANGNAVIKNVNFSDNGTLIYKGGENSAGNSLTLENNTFNSYNINAKAQNLIFNNNSFNSGSYSFNDTKNVTFKGTNTLINSDPFSRLKGSVSIDNNSIFNIERDLTDKTTYTLLSGDNIKYNNQALADNVFSKNLWDLIHYDGEQGTLLRTDNNTYFVQFTQSNGQKFVFEETFNPGSITYKYFTIHSSPFHTEADSKDIWNQVRKQFDFIPGKTPVCVGVCYIAPYKNQDLIGSSAFAWSLNFGATVVGTLLLGSAQEKANNNGGSIWFGKNNLLYLHGNFNATNIFLTNNFNVGNPNAGGGATINFNADETLSADGLNYTNFQTVAMGLQTSASQHSWANFNSKLSMEIKNSNFRDFTWGGFRFNSGRITFENTTFSGWTNINGATESGSSYVNMVANTDLIFTDSILGGGIRYDLKANNIIFNNTQMVVDVSKNVNQSSLNGNVTFNHSRLSVKPNAAINIGGDQTQTTLENASSLSFYNDSVANFNGTTAFNGVSYLNLNPNAQVSFNQANFNNANVTFYGIPLFGKTPNFGNSVRLINFKGDAKFNQATLNLRAKNIHLNFQGASTFENNSTMNLAESSQASFNALSVEGETNFNLNGSSLLSFNGNSVFNAPVNFYANNSQISFTHSATFNADASFDLGNNSTLNFQSVLLNSALNLLGNGGNNLAINAKGNFSFGSQGILNLSYMNLFGGDKKASVYDVLQAQNIDGLRGNNGYEKIRFYGIQIEKADYSFNNGVHSWSFTNPLNTTETITETLHNNRLKVQISQNGASNNAMFNLAPSLYDYQQNPYDESENSYNHTSDKAGTYYLSSSIKGFGKNNEIPGTYNAQNQPLQALHIYNQAISKQDLNMIASLGKEFLPKVAKLIASGALDNLNLNSPDSFETIFSILKEYGITLNQANWKSLLKIINNFSNTANYHFSQGSLVVGAIKEGQTNTNSVVWFGGDGYKNPCAVGDNTCQMFRQTNLGQLLNSSVPYLGYINANFKAKNIYITGTIGSGNAWGSGGSANVSFESATNLVLNQANIDAQGTDKIFSYLGKEGIDKLFGEKGLGNVLSNIVYEESLNDNAIPKDLANMIPKDLGSKTLSSLLSPTEVNNLLGVSAFKNAIMEILNSKTVGDVFGENGLLNALDPVKRKEIDQMLLEQIQAHSSGFEKFIVKTLGIENVENFINNWYGKQSLSSFANNFVPGGLNQALDKIGSSSDAKDLQSFLDKTTFGDILNQMINQAPLINKLISWLGPQDLSVLVNIALNSITNPSKELLGAISGMGQKVLNDLLGEGVVNKIMSNQVLGQMINKIIADKGFGGVYHQGLGSILPKSLQDELKKLGMGSLLKPKGLHNLWQKGNFNFVAKNHVFVNNSLFSNATGGELNFVAGKSIIFNGKNTINFTQYQGRLSFVSKDFSNISLDTLNATNGLTLNASKNDISVQKGQICVNVLDCMTAKGKTTQTNSSSSATAPTNETLEVSANNFAFLGTIKANGLVDFSKVLQNTTIGTLDLGPNATFKANNLIVNNAFNNNSNYRANISGNFNVAKGATFSTNENGLNVGGNFNSEGPLIFNLNNPTHQTIINVTGTSTIMSYNNQALINFNTQLKQGAYTLINANRMVYGYDNQTILGGSLSDYLKLYTLIDFNGKRMQLNGDSLSYDNQPVSIKDGGLVVSFKDNQGQMVYSSILYDKIQVTVSDKPMSIQAPSLEYYVKRIQGSAGLNAIKSAGNNSIMWLSELFAAKGGNPLFAPYYLQDNPTEHIVTLMKDITSALGMLSNSNLKNNSTDVLQLNTYTQQMSRLAKLSNFASFDSTDFSERLSSLKNQRFADAVPNAMDVILKYSQRDKLKNNLWATGVGGVSFVENGTGTLYGVNVGYDRFVRGVIVGGYAAYGYSGFYERITSSKSDNVDVGLYARAFIKKSELTFSVNETWGANKTQISSNDALLSMINQSYKYSTWTTNAKVNYGYDFMFKNKSIILKPQIGLRYYYIGMSGLEGVMNNVLYNQFKANADPSKKSVLTIDFALENRHYFNTNSYFYAIGGVGRDLLVNSMGDKLVRFIGNNTLSYRKGDLYNTFANITTGGEVRLFKSFYANAGVGARFGLDYKMIDIIGNIGMRLAF

SEQ ID NO: 91 - protein, 2902 aa, Helicobacter pylori J99
MKQFKKKPKKIKRSHQNQKTILKRPLWLMPLLIGGFASGVYADGTDILGLSWGEKSQKVCVHRPWYAIWSCDKWEEKTQQFTGNQLITKTWAGGNAANYYHSQNNQDITANLKNDNGTYFLSGLYNYTGGEYNGGNLDIELGSNATFNLGASSGNSFTSWYPNGHTDVTFSAGTINVNNSVEVGNRVGSGAGTHTGTATLNLNANKVTINSNISAYKTSQVNVGNANSVITINSVSLNGDTCSSLARVGVGANCSTSGPSYSFKGTTNATNTTFSNSSGSFTFEENATFSGAKLNGGAFTFNKKFNATNNTAFNSGSFTFKGTSSFNGANFSNASYTFNNQATFQNSSFNGGTFTFNDQTNQSTQHPQIQNSSFSGSATTLKGFATFEQAFNNSNHQLTIQNASFNNATFNNTGKITIEKDASFNNTSFNTPVDTNNMTISGGVTLSGKNDLKNGATLDFGSSKITLTQGTTFNLTSLGSEKSVTILNSRGGITYNHLLNHAINSLTNALKTNESSSKPQSFAQGLWDMITYNGVTGQLLNENAATSKPTDSSPSKSSTNSTQVYQVGYKIGDTIYKLQETFSHNSIIIQALESGTYTPPPVINGSKFDLSASNYINADMPWYNHKYYIPKSQNFTESGTYYLPSVQIWGSYTNSFKQTFSASNSNLVIGYNATWTDHNVSSSDTVAFGDTSGSALNGHCGPWPYYQCTGTTNGTYSAYHVYITANLRSGNRIGTGGAANLIFNGVDSINIANATITQHNAGAYSSSMTFSTQNMDNSQNLNGLNSNGKLLVYGTTFTNQAKDGKFIFNAGQATFENTNFNGGSYQFSGDSLNFSNNNQFNSGSFEIGAKNTIFNNANFNNSTSFNFNNSSATTSFVGDFTNANSNLQIAGNAVFGNSTNGSQNTANFNNTGSVNIAGNATFDNVVFNSPTNTSVKGKVTLNNITLKNLNAPLSFGDGTIVFSAHSVINIGEAITNGNPITLVSSSKAIEYNDAFSKNLWQLINYQGHGASSEKLVSSAGNGVYDVVYSFNNQTYNFQEVFSPNSISIRRLGVGMVFDYVDMEKSDRLYYQNALGFMTYMPNSYNNNLGNLNNTIYYYDNSIDFYASGKTLFTKAEFSQTFTGQNSAIVFGAKNIWTSVSDAPQSNVIIRFGDNKGAGSNDASGHCWNLQCIGFITGHYEAQKIYITGSIESGNRISSGGGASLNFNGLQGILLTNATLYNRAAGTQSSSMNFVSNSANIQAQNSYFIDDTAQNKGNPNFSFNALNLDFSNSSFRGYVGQTQSVFKFNAVNAISFTNSSNLSSGLYQMQAKSVLFDNSNLSVSVGTSSIKANAINLSQNASINASNHSTLELQGDLNLNDTSSLNLNQSAINVSNNATINDYASLIASNGSHLNFNGAVNFNSANITTSLSSSSIVFKGAVSLRGQFNLSNNSSLDFQGSSAITSNTAFNFYDNAFSQSPITFHQALDIKVPLSLGGNLLNPNNSSVLNLKNSQLVFSDQGSLNIANIDLLSDLNGNKNRVYNIIQADMNGNWYERINFFGMRINDGIYDAKNQTYSFTNPLNNALKITESFKNNQLSVTLSQIPGIKNTLYNIGSEIFNYQKVYNNANGVYSYSDDAQGVFYLTSSVKGYYNPNQSYQASGSNNTTKNNNLTSESSVISQTYNAQGNPISALHVYNKGYNFSNIKALGQMALKLYPEIKKILGNDFSLSSLSNLKGDALNQLTKLITPSDWKNINELIDNANNSVVQNFNNGTLIIGATKIGQTDTNSAVVFGGLGYQKPCDYTDIVCQKFRGTYLGQLLESISADLGYIDTTFNAKEIYLTGTLGSGNAWGTGGSASVTFNSQTSLILNQANIVSSQTDGIFSMLGQEGINKVFNQAGLANILGEVAMQSINKAGGLGNLIVNTLGSDSVIGGYLTPEQKNQTLSQLLGQNNFDNLMNDSGLNTAIKDLIRQKLGFWTGLVGGLAGLGGIDLQNPEKLIGSMSINDLLSKKGLFNQITGFISANDIGQVISVMLQDIVKPSDALKNDVAALGKQMIGEFLGQDTLNSLESLLQNQQIKSVLDKVLAAKGLGSIYEQGLGDLIPNLGKKGIFAPYGLSQVWQKGDFSFNAQGNVFVQNSTFSNANGGTLSFNAGNSLIFAGNNHIAFTNHSGTLNLLSNQVSNINVTMLNASNGLKINATNNNVSVSQGNLFINASCVQQSDPTTASATNPCTTAQNNASSSNASNNAPIALNNNDESLVVTANGFNFSGNIYANGVVDFSKIKGSANVKNLYLYNNAQFQANNLTISNQAVLEKNASFVTNNLNIQGAFNNNATQKIEVLQNLVIASNASLSTGIYGLEVGGALNNLGAIHFNLENSQTPVNPLIQVGGIINLNTTQTPFMNVSVANGGTYTLLKSSRYIDYNINPNSLQSYLKLYTLININGNHIEEKNGVLTYLGQRVLLQDKGLLLSVALPNSNNASQNNILSLSVLHNQIKMSYGNKVMDFTPPTLQDYIVGIQGQSALNQIEAVGGNNAIKWLSTLMMETKENPLFAPIYLENHSLNEILGVTKDLQNTASLISNPNFRNNATSLLEMASYTQQTSRLTKLSDFRAREGESNFSERLLELKNKRFSDPNPSEVFVKYSQLSKHPNNLWIQGVGGASFISGGNGTLYGLNVGYDRLVKSVILGGYVAYGYSGFNGNIMHSLANNVDVGMYARAFLKRNEFTLSANETYGGNASHINSSNSLLSVLNQRYNYNTWTTSVNGNYGYDFMFKQKSVVLKPQVGLSYHFIGLSGMKGKMQNPAYQQFVMHSNPSNESVLTLNMGLESRKYFGKNSYYFVTARLGRDLLIKAKGDNVVRFVGENTLLYRKGEIFNTFASVITGGEMHLWRLMYVNAGVGLKMGLQYQDLNITGNVGMRVAF

SEQ ID NO: 92 - protein, 2399 aa, Helicobacter pylori J99
MAFKKARLISRFISKGSFKLNKISKKFFTLNQILKREKPLKRHKKTKSIEKPFNKNKSFLKASVLLIGALGGLSHLRANECRYWSWSSWSYQDNIESGPNSPTHNSYCLFSSAQGSGTYYLNTLTTYSAGGASFTQKFNGGTLDIGGNIRFGGTGINGGDVGYITGTYNAQTMNFNSSHITTGNSYADGGGTTLNFNATNNITINQASFDNSDAGTQKSYMNFKGSNIKISGSSFTDDTNGGFNFSGNNNNSTISFNQTSFNQGTYNFSNSATLSFNNSNFNQGTYHFNSAQSTFENSNFNQGTYNFNDNTSFNNDTFNQGTYNFNSSKVSFSGANTLNSSSPFASLKGSVSFNSGAIFNLNQTLNNNQTYDILTTNGAIQYGVYQSYLWDLINYKGDKAISHVEVSNNTYDVTFDINGQDETLQETFSNQSIITQFLGDDLQQQAQQTYQEDVANSQNALNKVASDNTIANNDTSYTQSSNPTILKDAQGLENTNQQIQQDEKALEKDLAQIKQLANSTTGFNEQAFTQAQKQEQQDEQALQNDENAFNTEQEGLEQAIANAKHANPTPNPTPSPTPTPIKHTAPNTPPSQVPPTPPSQNLPKTNVWNGVYWLQNKTYSNKGIYYIDPNLSGQSGQSGNTLSTYTANLLGRSFGVNANNGTLIIGNNTESVNDNGLIWIGHGGFGYITGTFSAANIYLTNNFKTGEGVSNSDGGGANITFKASDNITMDGLNYNNAETVTKMIQTGASQHSYTTFDATNNISVTDSDFSDMTWGKFSFSAKNISFSNASFSGFTNPGGSSTISTNASNSLSFTDSRLNGGAIYNLQANSLIFNNTQAVFNVLYSRGTSNFNATTQLLGNTSFTLSSQSLLNFNGDTTLQNNANITLGNKSQAAFKNSLTLDNNSNLSLDNQSVLNANGTSAFNNQASLNIYNGSQAAFSSLFFNGGTLSLNANSKLNASSASFSNNTTINLDDSVLNANNTSSLNANINFQGASQADFGGNTTIDTASFNFDSASSLNFNNLTANGALNFNGYAPSLTKALMNVSGQFVLGNNGDINLSDINIFDNITKSVTYNILNAQKGITGISGANGYEKILFYGMKIQNATYSDNNNIQTWSFINPLNSSQIIQESIKNGDLTIEVLNNPNSASNTIFNIAPELYNYQDSKQNPTGYSYDYSDNQAGTYYLTSNIKGLFTPKGSQTPQTPGTYSPFNQPLNSLNIYNKGFSSENLKTLLGILSQNSATLKEMIESNQLDNITNINEVLQLLDKIKITQAQKQALLETINHLTDNINQTFNNGNLVIGATQDNVTNSTSSIWFGGNGYSSPCALDSATCSSFRNTYLGQLLGSTSPYLGYINADFKAKSIYITGTIGSSNAFESGGSADVTFQSANNLVLNKANIEAQATDNIFNLLGQEGIDKIFNQGNLANVLSQMAMEKIKQAGGLGNFIENALSPLSKELPASLQDETLGQLIGQNNLDDLLNNSGVMNEIQNIISQKLSIFGNFVTPSIIENYLAKQSLKSMLDDKGLLNFIGGYIDASELSSILGVILKDITNPPTSLQKDIGVVANDLLNEFLGQDVVKKLESQGLVSNIINNVISQGGLSGVYNQGLGSVLPPSLQNALKENDLGTLLSPRGLHDFWQKGYFNFLSNGYVFVNNSSFSNATGGSLNFVANKSIIFNGDNTIDFSKYQGALIFASNGVSNINITTLNATNGLSLNAGLNNVSVQKGEICINLANCPTTKNSSPANSSVTPTNESLSVHANNFTFLGTIISNGAIDLSQVTNNSVIGTLNLNENATLQANNLTITNAFNNASNSTANIDGNFTLNQQATLSTNASGLNVMGNFNSYGDLVFNLSHSVSHAIINTQGTATIMANNNPLIQFNASSKEVGTYTLIDSAKAIYYGYNNQITGGSSLDNYLKLYALIDINGKHMVMTDNGLTYNGQAVSVKDGGLVVGFKDSQNQYIYTSILYNKVKIAVSNDPINNPQAPTLKQYIAQIQGVQSVDSIDQAGGNQAINWLNKIFETKGSPLFAPYYLESHSTKDLTTIAGDIANTLEVIANPNFKNDATNILQINTYTQQMSRLAKLSDTSTFARSDFLERLEALKNKRFADAIPNAMDVILKYSQRNRVKNNVWATGVGGASFISGGTGTLYGINVGYDRFIKGVIVGGYAAYGYSGFHANITQSGSSNVNVGVYSRAFIKRSELTMSLNETWGYNKTFINSYDPLLSIINQSYRYDTWTTDAKINYGYDFMFKDKSVIFKPQVGLSYYYIGLSGLRGIMDDPIYNQFRANADPNKKSVLTINFALESRHYFNKNSYYFVIADVGRDLFINSMGDKMVRFIGNNTLSYRDGGRYNTFASIITGGEIRLFKTFYVNAGIGARFGLDYKDINITGNIGMRYAF

SEQ ID NO: 93 - protein, 1288 aa, Helicobacter pylori J99
MEIQQTHRKINRPLVSLVLAGALISAIPQESHAAFFTTVIIPAIVGGIATGTAVGTVSGLLSWGLKQAEEANKTPDKPDKVWRIQAGKGFNEFPNKEYDLYKSLLSSKIDGGWDWGNAARHYWVKGGQWNKLEVDMKDAVGTYKLSGLRNFTGGDLDVNMQKATLRLGQFNGNSFTSYKDSADRTTRVNFNAKNISIDNFVEINNRVGSGAGRKASSTVLTLQASEGITSSKNAEISLYDGATLNLASNSVKLNGNVWMGRLQYVGAYLAPSYSTINTSKVQGEVDFNHLTVGDQNAAQAGIIASNKTHIGTLDLWQSAGLNIIAPPEGGYKDKPNSTTSQSGTKNDKKEISQNNNSNTEVINPPNNTQKTETEPTQVIDGPFAGGKDTVVNIFHLNTKADGTIKVGGFKASLTTNAAHLNIGKGGVNLSNQASGRTLLVENLTGNITVDGPLRVNNQVGGYALAGSSANFEFKAGVDTKNGTATFNNDISLGRFVNLKVDAHTANFKGIDTGNGGFNTLDFSGVTDKVNINKLITASTNVAVKNFNINELIVKTNGISVGEYTHFSEDIGSQSRINTVRLETGTRSIFSGGVKFKSGEKLVINDFYYSPWNYFDARNVKNVEITRKFASSTPENPWGTSKLMFNNLTLGQNAVMDYSQFSNLTIQGDFINNQGTINYLVRGGKVATLNVGNAAAMMFNNDIDSATGFYKPLIKINSAQDLIKNTEHVLLKAKIIGYGNVSTGTNGISNVNLEEQFKERLALYNNNNRMDTCVVRNTDDIKACGMAIGNQSMVNNPDNYKYLIGKAWRNIGISKTANGSKISVYYLGNSTPTENGGNTTNLPTNTTNNAHSANYALVKNAPFAHSATPNLVAINQHDFGTIESVFELANRSKDIDTLYTHSGAQGRDLLQTLLIDSHDAGYARQMIDNTSTGEITKQLNAATDALNNVASLEHKQSGLQTLSLSNAMILNSRLVNLSRKHTNHINSFAQRLQALKGQEFASLESAAEVLYQFAPKYEKPTNVWANAIGGASLNSGSNASLYGTSAGVDAFLNGNVEAIVGGFGSYGYSSFSNQANSLNSGANNANFGVYSRFFANQHEFDFEAQGALGSDQSSLNFKSTLLQDLNQSYNYLAYSATARASYGYDFAFFRNALVLKPSVGVSYNHLGSTNFKSNSQSQVALKNGASSQHLFNANANVEARYYYGDTSYFYLHAGVLQEFAHFGSNDVASLNTFKINAARSPLSTYARAMMGGELQLAKEVFLNLGVVYLHNLISNASHFASNLGMRYSF

SEQ ID NO: 94 - protein, 744 aa, Helicobacter pylori J99
MKKHILSLTLGSLLVSTLSAEDDGFYTSVGYQIGEAAQMVTNTKGIQDLSDRYESLNNLLNRYSTLNTLIKLSADPSAINAVRENLGASAKNLIGDKANSPAYQAVLLAINAAVGFWNVVGYVTQCGGNANGQKSISSKTIFNNEPGYRSTSITCSLNGHSPGYYGPMSIENFKKLNEAYQILQTALKRGLPALKENNGKVNVTYTYTCSGDGNNNCSSQVTGVNNQKDGTKTKIQTIDGKSVTTTISSKVVDSRADGNTTGVSYTEITNKLEGVPDSAQALLAQASTLINTINNACPYFHASNSSEANAPKFSTTTGKICGAFSEEISAIQKMITDAQELVNQTSVINEHEQTTPVGNNNGKPFNPFTDASFAQGMLANASAQAKMLNLAEQVGQAINPERLSGTFQNFVKGFLATCNNPSTAGTGGTQGSAPGTVTTQTFASGCAYVGQTITNLKNSIAHFGTQEQQIQQAENIADTLVNFKSRYSELGNTYNSITTALSNIPNAQSLQNAVSKKNNPYSPQGIDTNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKDSDHAAQHGIELGLKIPTINTNYYSFMGAELKYRRLYSVYLNYVFAY

SEQ ID NO: 95 - protein, 1237 aa, Helicobacter pylori J99
MIKKAKKFIPFFLIGSLLAEDNGWYMSVGYQIGGTQQFINNKQLLENQNIINSITQSAINIAGPTTGLITLSSQTVIDALGYGVSNTVGNQLEGISNILNQIGKRKDFYSSRQISSISQQIIGLKGSSDPLKAHSSQITAKLLSNTQSAFDQGIALSSNIISAVNSLNPSNNSQEVKAQLQNTAQSMAELLQQIEHSITKTTSTTYAQSLLSNLTDAVNASSNNTTYVSALVNALNTLGVGVFPTTTSTHVVLNPPGQVVFYPTNSLLGSTSSNSNNQQQYNNTLLMNTLQGELSTNNQNNPNGCANQIQCLEQFIQNLTPLAATPTSTNQANQQVQAIAQKLQSVAINALDNNAINNTTYNLNNLHNALNFQAYQSTIEQYNNALKQISWISFSEPKNLLKNTSNNYQIGTVTNDQGQNISAYDCTSATGSLSSDASSGISCSATSSTNNTNSFDNSLVATSKVQTINGKEQIGVNSFNLVSQVWSVYNSLKTSEENLQKNAKILCNNGSQSGTSPCNSSSGGLSISGNAQLQNILSPTNGTTTNTQAKSNASKLKAMVMVNNEEEAKTTNFNQSSGPTTQSSNSTVMGALNTVLQNVSNFQQSIQSAFQNQENNIQAWANALYNTSNPNGNQSQNLTTNNNQDLRIQLRANFYQLINTINQQVPTDMNALINQSQQTQQTSGSASTTNNACASGMGSSGNWCYQQWSDSKAYYSGLQSALGYQTQATTQNGSSGGSNITYNVQQITLTSGGLLNQIITNLKSVNGGSNGGSSGNGTSQINTAYQMLTDASDGKLGTYNSSNSSNSSNSGNNNGYTPCNSTNGSNGTSGSNCYEPNKQQNATTATTTTDSNLQKVYNDAQKIANIIASSGNNKGVENGLKQFFEALKSNSSSLSNLCGNGSSGSSSTCSGGLINLLGAIPTNGVSDTNNLINLLTEFIKTAGFIQNKDSNVSTSLTSAFQAITSAISQGFQALQNDISPNAILTLLQEITSNTTTIQSFSQTLRQLLGDKTFFMVQQKLIDAMINARNQVQNAQNQANNYGSQPVLSQYAAAKSTQHGMSNGLGVGIGYKYFFGKARKLGLRHYFFFDYGFSEIGLANQSVKANIFAYGVGTDFLWNLFRRTYNTKALNFGLFAGVQLGGATWLSSLRQQIIDNWGNANDIHSTNFQVALNFGVRTNFAEFKRFAKKFHNQGVISQKSVEFGIKVPLINQAYLNSAGADVSYRRLYTFYINYIMGF

SEQ ID NO: 96 - protein, 527 aa, Helicobacter pylori J99
MKQNLKPFKMIKENLMTQSQKVRFLAPLSLALSLSFNPVGAEEDGGFMTFGYELGQVVQQVKNPGKIKAEELAGLLNSTTTNNTNINIAGTGGNVAGTLGNLFMNQLGNLIDLYPTLKTNNLHQCGSTNSGNGATAAAATNNSPCFQGNLALYNEMVDSIKTLSQNISKNIFQGDNNTTSANLSNQLSELNTASVYLTYMNSFLNANNQAGGIFQNNTNQAYENGVTAQQIAYVLKQASITMGPSGDSGAAGAFLDAALAQHVFNSANAGNDLSAKEFTSLVQNIVNNSQNALTLANNANISNSTGYQVSYGGNIDQARSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYWVYGYAF

SEQ ID NO: 97 - protein, 703 aa, Helicobacter pylori J99
MKKTLLLSLSLSFGLHAEDDGFYASAGIRIGEAAQMVKNTKGIQQLSENYEKLNNLLNNYNTLNTLVKLSSDPSAVNDARDNLGSSTRNLLDVKANSPAYQAVLLALNAAVGLWQVTSYAFTACGPGSNENANGGIQTFNNVPGQNTTTITCNSYYEPGHGGPISTKNYAIINKAYQIIQKALTANGEGIPVLSNTTTKLDFTINGDKRTGGEPNKKLVYPWSHGKAISTSWNATITAPTTENINTTNSAQELLKQASIIITTLNSACPNFQNGGSGYWAGISGNGTMCGMFKNEISAIQGMIANAQEAVAQAKIVSENTQNQNSLDAGKPFNPYTDASFAESMLKNAQAQAEILNQAEQVVKNFEKIPTAFVNDSLGVCYEVQGGERRGTNPGQTTSNTWGAGCAYVGQTITNLKNSIAHFGTQEQQIQQAENIADTLVNFKSRYSELGNTYNSITTALSNIPNAQSLQNAVSKKNNPYSPQGIDTNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKDSDHAAQHGIELGLKIPTINTNYYSFMGAELKYRRLYSVYLNYVFAY

SEQ ID NO: 98 - protein, 520 aa, Helicobacter pylori J99
MIKKNRTLFLSLALCASISYAEDDGGFFTVGYQLGQVMQDVQNPGGAKSDELARELNADVTNNILNNNTGGNVAGALSNAFSQYLYSLLGAYPTKLNGNDVSANALLSGAVGSGTCAAAGTAGGTTLNTQSACTAAGYYWLPSLTDRILSTIGSQTNYGTNTNFPNMQQQLTYLNAGNVFFNAMNKALEKNGTATANSTSSTSGATGSDGQTYSQQAIQYLQGQQNILNNAANLLKQDELLLEAFNSAVAANIGNKEFNSAAFTGLVQGIIDQSQLVYNELTKNTISGSAVNNAGINSNQANAVQGRASQLPNALYNVQVTLDKINALNNQVRSMPYLPQFRAGNSRATNILNGFYTKVGYKQFFGKKRNIGLRYYGFFSYNGASVGFRSTQNNVGLYTYGVGTDVLYNIFSRSYQNRSVDMGFFSGIQLAGETFQSTLRDDPNVKLHGKINNTHFQFLFDFGMRMNFGKLDGKSNRHNQHTVEFGVVVPTIYNTYYKSAGTTVKYFRPYSVYWSYGYSF

SEQ ID NO: 99 - protein, 690 aa, Helicobacter pylori J99
MKKKFLSLTLGSLLVSALSAEDNGFFVSAGYQIGESAQMVKNTKGIQDLSDSYERLNNLLTNYSVLNALIRQSADPNAINNARGNLNASAKNLINDKKNSPAYQAVLLALNAAAGLWQVMSYAISPCGPGKDTSKNGGVQTFHNTPSNQWGGTTITCGTTGYEPGPYSILSTENYAKINKAYQIIQKAFGSSGKDIPALSDTNTELKFTINKNNGNTNTNNNGEEIVTKNNAQVLLEQASTIITTLNSACPWINNGGAGGASSGSLWEGIYLKGDGSACGIFKNEISAIQDMIKNAAIAVEQSKIVAANAQNQRNLDTGKTFNPYKDANFAQSMFANAKAQAEILNRAQAVVKDFERIPAEFVKDSLGVCHEVQNGHLRGTPSGTVTDNTWGAGCAYVGETVTNLKDSIAHFGDQAERIHNARNLAYTLANFSSQYQKLGEHYDSITAAISSLPDAQSLQNVVSKKTNPNSPQGIQDNYYIDSNIHSQVQSRSQELGSNPFRRAGLIAASTTNNGAMNGIGFQVGYKQFFGKNKRWGARYYGFVDYNHTYNKSQFFNASSDVWTYGVGSDLLVNFINDKATKHNKISFGAFGGIALAGTSWLNSQYVNLANVNNYYKAKINTANFQFLFNLGLRMNLARKKHRATDNAAQHGIELGTKIPTINTNYYSLLGTTLQYRRLYSVYLNYVFAY

SEQ ID NO: 100 - protein, 696 aa, Helicobacter pylori J99
MKIKKSLFALSFSLMASLSRAEDDGFYMSVGYQIGEAVQKVKNTGALQNLADRYDNLSNLLNQYNYLNSLVNLASTPSAITGAIDNLSSSAINLTSATTTSPAYQAVALALNAAVGMWQVIAFGISCGPGPNLGPEHLENGGVRSFDNTPNYSYNTGSGTTTTTCNGASNVGPNGILSSSEYQVLNTAYQTIQTALNQNQGGGMPALNSSKNMVVNINQTFTKNPTTEYTYPDGNGNYYSGGSSIPIQLKISSVNDAENLLQQAATIINVLTTQNPHVNGGGGAWGFGGKTGNVMDIFGDSFNAINEMIKNAQAVLEKTQQLNANENTQITQPDNFNPYTSKDTQFAQEMLNRANAQAEILSLAQQVADNFHSIQGPIQQDLEECTAGSAGVINDNTYGSGCAFVKETLNSLEQHTAYYGNQVNQDRALSQTILNFKEALSTLGNDSKAINSGISNLPNAKSLQNMTHATQNPNSPEGLLTYSLDTSKYNQLQTVAQELGKNPFRRIGVINYQNNNGAMNGIGVQAGYKQFFGKKRNWGLRYYGFFDYNHAYIKSNFFNSASDVWTYGVGMDALYNFINDKNTNFLGKNNKLSVGLFGGFALAGTSWLNSQQVNLTMMNGIYNANVSASNFQFLFDLGLRMNLARPKKKDSDHAAQHGMELGVKIPTINTDYYSFMGAELKYRRLYSVYLNYVFAY

SEQ ID NO: 101 - protein, 696 aa, Helicobacter pylori J99; identical to SEQ ID NO: 100

SEQ ID NO: 102 - protein, 841 aa, Helicobacter pylori J99
MHKKVLLALTASLICQESLFAKDKDYTLGKVSTAGKKDRSDYSGQVNLGYSGITAPKSWQDEEVKKYTGSRTVISNKALTQQANQSIEEALQNVPGLQIRNATGVGAMPTIQIRGFGAGGSGHSDATLMLVNGIPVYMAPYAHIELDIFPVTFQAIDRIDVIKGGGSVQYGPNTYGGIVNIITKPIPNQWENQAAERITYWAKARNAGFAAPPDKTGDPSFIKSLGNNLLYNTYVRSGGMINKHVGIQAQANWVRGQGFRDNSPSSISNYWLDGVYDINESNGIKAYYQYYDFAIAQPGSLSEQDYKINRFANLRPLNQKGGRSQRFGAVYENRFGDLDRVGGTFSFTYYGQLMTRDFQVSSSYNSANMVTCFSEAACRAAGLPAGYNLAVPYYATNYNGWAEVENPVRSINNAFEPKVNLIVNTGKVRQTFIMGLRFMTTTFLQRQYLNTNECATKTSGEGAGFLCEGPNVMSGWKPHIKHGVYRNWNNWRNNYTAVYLSDRIEAWDGRFFIVPGLRYAFVQYNNENASNWMQIPEKDLRKIKHMNNWMPSTNIGFIPVQGDHNVLTYFNYQRSFVPPQLDVLSYGGAEYFTQHFDTVEAGARYTYKDKFSFNADYFRIWARDFATGQYSVYTSGPMKGNVRPINGYSQGVELELYYRPIRGLQFHAAFNYIDTRVTSHGPLTDLNGDVLKGTSYNKHFPFVSPFQFIFDARYNWRKTTIGISSYFYSRAYSGISNSAAGGYYGMQYYSGGNNYESVLNSGYQCEAWCMTQHEGLLPWYWVWNIQVSQIFWENGRHRVTGSLQINNIFNMKYYFTGIGSSPAGLQPAPGRSVTAYLNYTF

SEQ ID NO: 103 - protein, 668 aa, Helicobacter pylori J99
MKKTLLLSLSASSLLNAEDNGFFISAGYQIGEAAQMVKNTGELKKLSDTYENLSNLLTNFNNLNQAVTNASSPSEINAAIDNLKANTQGLIGEKTNSPAYQAVYLALNAAVGLWNVIAYNVQCGPGNSGQQSVTFEGQPGHNSSSINCNLTGYNNGVSGPLSIENFKKLNQAYQTIQQALKQDSGFPVLDSAGKQVTITITTQTNGANKSETTTTTTTTNDAQTLLQEASKMISVLTTNCPWVNHNQGQNGGAPWGLDTAGNVCQVFATEFSAVTSMIKNAQEIVTQAQSLNQQNNQNAPQDFNPYTSADRAFAQNMLNHAQAQAKILELADQMKKDLNTIPSQFITNYLAACHNGGGTLPDAGVTNNTWGAGCAYVEETITALNNSLAHFGTQAEQIKQSELLARTILDFRGSLSNLNNTYNSITTTASNTPNSPFLKNLISQSTNPNNPGGLQAVYQVNQSAYSQLLSATQELGHNPFRRVGLISSQTNNGAMNGIGVQVGYKQFFGEKRRWGLRYYGFFDYNHAYIKSSFFNSASDVFTYGVGTDVLYNFINDKTTKNSKISFGVFGGIALAGTSWLNSQYVNLATFNNFYSAKMNVANFQFLFNLGLRMNLAKNKKKASDHAAQHGVELGVKIPTINTNYYSLLGTQLQYRRLYSVYLNYVFAY

SEQ ID NO: 104 - protein, 668 aa, Helicobacter pylori J99
MRKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLNNVKLSFTDAQGNTIDLGVIETIPKHSKIVLPGEAFDSLKEAFDKIDPYTLFLPKFEATSTSISDTNTQRVFETLNNIKTNLIMKYSNENPNNFNTCPYNNNGNTKNDCWQNFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVEAYALDPKKLFGNDLKTINLEDLRTILHEFSHTKGYGHNGNMTYQRVPVTKDGQVEKDSNGKPKDSDGLPYNVCSLYGGSNQPAFPSNYPNSIYHNCADVPAGFLGVTAAVWQQLINQNALPINYANLGSQTNYNLNASLNTQDLANSMLSTIQKTFVTSSVTNHHFSNASQSFRSPILGVNAKIGYQNYFNDFIGLAYYGIIKYNYAKAVNQKVQQLSYGGGIDLLLDFITTYSNKNSPTGIQTKRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 105 - protein, 220 aa, Helicobacter pylori J99
MNKTTIKILMGMALLSSLQAAEAELDEKSKKPKFADRNTFYLGVGYQLSAINTSFSTSSIDKSYFMTGNGFGVVLGGKFVAKTQAVEHVGFRYGLFYDQTFSSHKSYISTYGLEFSGLWDAFNSPKMFLGLEFGLGIAGATYMPGGAMHGIIAQYLGKENSLFQLLVKVGFRFGFFHNEITFGLKFPVIPNKKTEIVDGLSATTLWQRLPVAYFNYIYNF

SEQ ID NO: 106 - protein, 643 aa, Helicobacter pylori J99
MKKTKKTILLSLTLAASLLHAEDNGVFLSVGYQIGEAVQKVKNADKVQKLSDVYEQLSKLLANDNGTSSKTSAQAINQAVNNLNESAKTLAGGTTNSPAYQATLLALRSALGLWNSMGYAVVCGGYIKKPGENNQKNFHYTDENGNGTTINCGGSTNSNGTHSPNGTNTLKADKNVSLSIEQYEKIHEAYQILSKALKQAGLAPLNSKGEKLEAHVTTSKDQQGTSSDQTTTTTSVIDTTNDAQNLLTQAQTIVNTLKDYCPMLIAKSSSNGGTNGANTPSWQTAGGGKNSCATFGAEFSAISDMISNAQKIVQETQQLNANQPKNITQPNNFNLNSPGSLTALAQSMLKNAQSQTEILKLANQVASDFDKLSSGYLKDYIGKCDVSGVSSSNMTPQNMNTTWGKGCAGVEETLTSLKASTTDFNNQTTPQLDQAQTLANTLTQELGNNPFKRVGIIGSQTNNGAMNGLGVQAGYKQFFGQKRRWGLRYYGFFDYNHTYIKSSFFNSSSDVLTYGVGSDLLFNFINDKNTNFLGKNNKISVGLFGGIALAGTSWLNSQFVNLKTISNVYSAKVNTANFQFLFNLGLRTNLARPKKKDSDHSAQHGMELGVKIPTINTNYYSYLGTKLEYRRLYSVYLNYVFAY

SEQ ID NO: 107 - protein, 483 aa, Helicobacter pylori J99
MKKTILLSLMVSSLFAENDGVYMSVGYQIGEAAQMVKNTGEIQKVSNAYENLNNLLTRYNELKQTASNTDSSTAQAIDNLEKSASRLKTTPNTANQAVSSALSSAVGMWQVIASNLANNSLSSSEYEKLKATSQLLQNTLENKNNNLKIENDYDQLLTQASTIINTLQSQCPGVDGGNGKPWGINTSGNACAIFGSTFNAINSMIDSAKKAAADARRTAPESPNQQNAFTNADFNKNLNQVSSVINDTISYLKGDNLETIYNTIQKTPNSKGFQSLVSRSSYSYSLNETQYSQFQTTTKEFGHNPFRSVGLINSQSNNGAMNGVGVQLGYKQFFGKNKFFGIRYYGFFDYNYAYIKSNFFNSASNVFTYGAGSDLLLNFINGGSDRNRKVSFGIFGGIALAGTTWLNNQSANLKITNSAYSAKINNTNFQFLFNTGLRLQGIHHGIELGVKIPTINTNYYSFMGAKLAYRRLYSLYLNYVLAY

SEQ ID NO: 108 - protein, 471 aa, Helicobacter pylori J99
MPKASQVLFFGAFLSTSLQGFEAKLNGFVDQSSTIGFNQHKINKERGIYPMQQFATIAGYLGLGFSLLPKKVSDHVLKGKIGGMVGSIFYDGTKKFEDGSVAYNLFGYYDGFMGVYTNILQTDSLETQNMKHNKNVRNYVFSDAYLEYAYKNYFEIKAGRYLSTMPYKSGQTQGFQVSGQYKHARLTWFSSWGRAFAYGSFLMDWFAARTTYSGGFTKNNNGGYDSHGRKVLYGTHAVQLTYKPHRFLIEGFYYLSPQIFNAPGVKIGWDSNPNFSGTGFRSDTAIIGFFPIYYPWMIVKSNGSPVYRYDTPATQNGQNLIIRQRFDINNYNVSIAFYKVFQNANGWIGNMGNPSGVIMGSNSVYAGFTGTALKRDAATIFLSCGGTHFAKKFTWKFATQYSNSVVSWEARAMISLGYKFTEYLSGSVDLAYYGVHTNKGFKPGENGPVPKNFPALYSDRSALYTALVASF

SEQ ID NO: 109 - protein, 751 aa, Helicobacter pylori J99
MLRLVSKTICLSLISLFNPLEAFQKHQKDVFFVEAGFETGLLEGAQTKEQAIAQNTQNTQKIYENPLTHPQTKEQPKEQNKSDTATPQSVYGRYYILQNTILEKATELFTAANINGNGLTFYSQNPVYVMAYNKDNAEFEGYGNNSVVVIQNFLPYNLNNIELSYTDAQGKAVNLGVIETIPKDSQIILPASLFNNFSNDSPFNSDGLQQLQTTTTPFSDANTQSLFEKLSQITTNLQMTYENTDPFSSGNNDPNGPLASPKPHYECPGYKKSCQVASVSFTPQTAEELTNLMLDMIAVFDSKSWEEAVLNAPFQFSNSPSECGIDYPKCVNPFNNGLVDPKDEKYALTPEEVINSYRVANELTVNLLNAAKGFLGLGSQLGSANAPDDDGFNQGVLGIAPFALDPEKLFGKNLNKVAILALRDIIHEYGHTLGYTHNGNMTYQRVRLCQEGNGPEARCEGGHEVEKNGKEELEFSNGHEVRDHDGYTYDVCSRFGGKNQPAFPSNYPNSIYTNCAQVPAGLIGVTTAVWQQLINQNALPINFANLNSQTSHLNAGLNAQNFATSMVSAIAQNFSTTSTTTYRSSSKNFRSPILGVNVKIGYQHYFNDYIGLAYYGIIQYNYAQANDEKIQQLSYGGGMDVLFDFITTYTNKKQDHPTKKVFASSFGVFGGLRGLYNSYYVFNQVKGSGNLDIVTGFNYRYKHSKYSIGVSVPLIQSGIKIASNNGIYADSVVLNEGGSHFKVFFNYGWVF

SEQ ID NO: 110 - protein, 697 aa, Helicobacter pylori J99
MQNFVFNKKWLIYSSLLPLFFLNPLMAEDDGFFMGVSYQTSLAVQRVDNSGLNASQDASTYIRQNAIALESAAVPLAYYLEAMGQQTRVLMQMLCPDPSKRCLLYAGGYQNGQNNNGDTGNNPPRGNVNATFDMQSLVNNLNKLTQLIGETLIRNPENLPNSKVFNVKFGNQSTVIALPEGLANTMDALNNDITNALTTLWYNQTLTNKSFSTPSNTSVNFSPQVLQHLLQDGLATANNNQTICSTQNQCTATNEAKSIAQNAQNIFQALMQAGILGGLANEKQFGFTYNKAPNGSDSQQGYQSFSGPGYYTKNDNTTQAPLKALPAGATIGSGNGQYTYHPSSAVYYLADSIIANGITASMIFSGMQNFANKAAKLIGTSSYNQMQDAINYGESLLSNTVAYGDFITNWVAPYLDLNNKGLNFLPNYGGQLNGANNQTPQLTPQQAQQEQKVIMNQLEQATNAPTPAQINRILANPYSPTAKTLMAYGLYRSKAVIGGVIDEMQTKVNQVYQMGFARNFLEHNSNSNNMNGFGVKMGYKQFFGKKRMFGLRYYGFYDFGYAQFGTESSLVKATLSSYGAGTDFLYNVFTRKRGTEAIDIGFFAGIQLAGQTWKTNFLDQVDGNHLKPKDTSFQFLFDLGIRTNFSKIAHQKRSRFSQGIEFGLKIPVLYHTYYQSEGVTAKYRRDFSFYVGYNIGF

SEQ ID NO: 111 - protein, 651 aa, Helicobacter pylori J99
MKKTILLSLSLSLASSLLHAEDNGFFVSAGYQIGEAVQMVKNTGELKNLNEKYEQLSQYLNQVASLKQSIQNANNIELVNSSLNYLKSFTNNNYNSTTQSPIFNAVQAVITSVLGFWSLYAGNYLTFFVVNKDTQKPASVQGNPPFSTIVQNCSGIENCAMNQTTYDKMKKLAEDLQAAQQNATTKANNLCALSGCATTQGQNPSSTVSNALNLAQQLMDLIANTKTAMMWKNIVIAGVSNVSGAIDSTGYPTQYAVFNNIKAMIPILQQAVTLSQSNHTLSASLQAQATGSQTNPKFAKDIYAFAQNQKQVISYAQDIFNLFSSIPKDQYRYLEKAYLKIPNAGKTPTNPYRQEVNLNQEIQTIQNNVSYYGNRVDAALSVAKDVYNLKSNQTEIVTTYNNAKNLSQEISKLPYNQVNTKDIITLPYDQNAPAAGQYNYQINPEQQSNLSQALAAMSNNPFKKVGMISSQNNNGALNGLGVQVGYKQFFGESKRWGLRYYGFFDYNHGYIKSSFFNSSSDIWTYGGGSDLLVNFINDSITRKNNKLSVGLFGGIQLAGTTWLNSQYMNLTAFNNPYSAKVNASNFQFLFNLGLRTNLATAKKKDSERSAQHGVELGIKIPTINTNYYSFLGTKLEYRRLYSVYLNYVFAY

SEQ ID NO: 112 - protein, 744 aa, Helicobacter pylori J99
MLKLASKTICLSLISSFTAVEAFQKHQKDGFFIEAGFETGLLQGTQTQEQTIATTQEKPKPKPKPKPITPQSTYGKYYISQSTILKNATELFAEDNITNLTFYSQNPVYVTAYNQESAEEAGYGNNSLIMIQNFLPYNLNNIELSYTDDQGNVVSLGVIETIPKQSQIILPASLFNDPQLNADGFQQLQTNTTRFSDASTQNLFNKLSKVTTNLQMTYINYNQFSSGNGSGSKPPCPPYENQANCVAKVPPFTSQDAKNLTNLMLNMMAVFDSKSWEDAVLNAPFQFSDNNLSAPCYSDYLTCVNPYNDGLVDPKLIAKNKGDEYNIENGQTGSVILTPQDVIYSYRVANNIYVNLLPTRGGDLGLGSQYGGPNGPGDDGTNFGALGILSPFLDPEILFGKELNKVAIMQLRDIIHEYGHTLGYTHNGNMTYQRVRMCEENNGPEERCQGGRIEQVDGKEVQVFDNGHEVRDTDGSTYDVCSRFKDKPYTAGSYPNSIYTDCSQVPAGLIGVTSAVWQQLIDQNALPVDFTNLSSQTNYLNASLNTQDFATTMLSAISQSLSSSKSSATTYRTSKTSRPFGAPLLGVNLKMGYQKYFNDYLGLSSYGIIKYNYAQANNEKIQQLSYGVGMDVLFDFITNYTNEKNPKSNLTKKVFTSSLGVFGGLRGLYNSYYLLNQYKGSGNLNVTGGLNYRYKHSKYSIGISVPLVQLKSRIVSSDGAYTNSITLNEGGSHFKVFFNYGWIF

SEQ ID NO: 113 - protein, 657 aa, Helicobacter pylori J99
MRKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLNNVKLSFTDAQGNVIDLGVIETIPKHSKIVLPGEAFDSLKIDPYTLFLPKIEATSTSISDANTQRVFETLNKIKTNLVVNYRNENKFKDHENHWEAFTPQTAEEFTNLMLNMIAVLDSQSWGDAILNAPFEFTNSPTDCDNDPSKCVNPGTNGLVNSKVDQKYVLNKQDIVNKFKNKADLDVIVLKDSGVVGLGSDITPSNNDDGKHYGQLGVVASALDPKKLFGDNLKTINLEDLRTILHEFSHTKGYGHNGNMTYQRVPVTKDGQVEKDSNGKPKDSDGLPYNVCSLYGGSNQPAFPSNYPNSIYHNCADVPAGFLGVTAAVWQQLINQNALPINYANLGSQTNYNLNASLNTQDLANSMLSTIQKTFVTSSVTNHHFSNASQSFRSPILGVNAKIGYQNYFNDFIGLAYYGIIKYNYAKAVNQKVQQLSYGGGIDLLLDFITTYSNKNSPTGIQTKRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 114 - protein, 219 aa, Helicobacter pylori J99
MSLATSYNVSNNFSKFNIKRVRGYLICLVCNTPKMIQRGLNGVSFYGCSDYVNKGDCKGVLREINGSMKMVCLHCENTPIMEKVESGRGGAYACKNCNRKFYFIDLAKQNERKKDLEKEKKELLNKIEKQKIKHLERFILAGVKANIKENSFFLGCKNYPKCEWTASMDSQDLKCPKCNRLMKRKKNFKNNEFFTATSLTLNAIEFCLYINLKKKETNV

SEQ ID NO: 115 - protein, 465 aa, Helicobacter pylori J99
MEIKKYFLYALFFLLFSGLFLSKLQAYKFNMSIVGKVSSYTKFGFNNQRYQPSKDIYPTGSYTSLLGELNLSMGLYKGLRAEVGAMMAALPYDSTAYQGNNIPNGQPGSRTDPFGAGIFWQYIGWYAGHSGLNVQKPRLAMVHNAFLSYNYKKDKFSFGVKGGRYDAEEYDWFTSYTQGVEGFVKYKDTRLRVMYSDARASASSDWFWYFGRYYTSGKALMIADLKYEKDNLKINPYFYAIFQRMYAPGINITYDTNPNFNNKGFRFVGTFVGFFPIFATPANQNDIILFQQVPLGKSGQTYFFRTRFYYNKWQFGGSVYKNIGNANGDIGIYGDPLGYNIWTNSIYDAEINNIVGADVINGFLYVGSQYRGFSWKILGRWTDSPRADERSLALFLSYFSNKYNIRMDLKLEYYGNITKKGYCIGYCGMYVPVDPNGPGTQPLTHNVYSDRSHIMFNITYGFRIY

SEQ ID NO: 116 - protein, 638 aa, Helicobacter pylori J99
MKKTILLSLSLSLASSLLHAEDNGFFVSAGYQIGEAVQMVKNTGELKNLNDKYEQLSQSLAQLASLKKSIQTANNIQAVNNALSDLKSFASNNHTNKETSPIYNTAQAVITSVLAFWSLYAGNALSFHVTGLNDGSNSPLGRIHRDGNCTGLQQCFMSKETYDKMKTLAENLQKAQGNLCALSECSSNQSNGGKTSMTTALQTAQQLMDLIEQTKVSMVWKNIVIAGVTNKPNGAGAITSTGHVTDYAVFNNIKAMLPILQQALTLSQSNHTLSTQLQARAMGSQTNREFAKDIYALAQNQKQILSNASSIFNLFNSIPKDQLKYLENAYLKVPHLGKTPTNPYRQNVNLNKEINAVQDNVANYGNRLDSALSVAKDVYNLKSNQTEIVTTYNDAKNLSEEISKLPYNQVNVTNIVMSPKDSTAGQYQINPEQQSNLNQALAAMSNNPFKKVGMISSQNNNGALNGLGVQVGYKQFFGESKRWGLRYYGFFDYNHGYIKSSFFNSSSDIWTYGGGSDLLVNFINDSITRKNNKLSVGLFGGIQLAGTTWLNSQYMNLTAFNNPYSAKVNASNFQFLFNLGLRTNLATAKKKDSERSAQHGVELGIKIPTINTNYYSFLGTKLEYRRLYSVYLNYVFAY

SEQ ID NO: 117 - protein, 528 aa, Helicobacter pylori J99
MKLKKRKVAATLLKRLTLPLLFTTGSLGAVTYEVHGDFINFSKVGFNRSPINPVKGIYPTETFVNLTGKLEGSVHLGRGWTVNVGGVLGGQVYDNTRYDRWAKDFTPPSYWDKTSCGTDSLSLCMNATKMWQQQGPGGIIDPRGIGYMYMGEWNGLFPNYYPANAYLPGHSRRYEVYKANLTYDSDRVHMVMGRFDVTEQEQMDWIYQLFQGFYGTFKLTKNMKFLLFSSWGRGIADGQWLFPIYREKPWGIHKAGIIYRPTKNLMIHPYVYLIPMVGTLPGAKIEYDTNPEFSGRGIRNKTTFYVLYDYRWNNAEYGRYAPARYNTWDPFLDNGKWRGLQGPGGATLYLHHHIDINNYFVVGGAYLNIGNPNMNLGTWGNPVALDGIEQWVGGIYSLGFAGIDNITDADAFTEYVKGGGKHGKFSWSVYQRFTTAPRALEYGIGMYLDYQFSKHVKAGLKLVWLEFQIRAGYNPGTGFLGPNGQPLNLNNGLFESSAFAQGPQNMGGIAKSITQDRSHLMTHISYSF

SEQ ID NO: 118 - protein, 587 aa, Helicobacter pylori J99
MKNFSPLYCLKKLKKRHLIALSLPLLSYANGFKIQEQSLNGTALGSAYVAGARGADASFYNPANMGFTNDWGENRSEFEMTTTVINIPAFSFKVPTTNQGLYSVTSLEIDKSQQNILGIINTIGLGNILKALGNTAATNGLSQAINRVQGLMNLTNQKVVTLASKPDTQIVNGWTGTTNFVLPKFFYKTRTHNGFTFGGSFTAPSGLGMKWNGKGGEFLHDVFIMMVELAPSMSYTINKRFSVGVGLRGLYATGSFNNTVYVPLEGASVLSAEQILNLPNNVFADQVPSNMMTLLGNIGYQPALNCQKAGGDMSDQSCQEFYNGLKKIMGYSGLIKASANLYGTTQVVQKSNGQGVSGGYRVGSSLRVFDHGMFSVVYNSSVTFNMKGGLVAITELGPSLGSVLTKGSLNINVSLPQTLSLAYAHQFFKDRLRVEGVFERTFWSQGNKFLVTPDFANATYKGLSGTVASLDSETLKKMVGLANFKSVMNMGAGWRDTNTFRLGVTYMGKSLRLMGAIDYDQAPSPQDAIGIPDSNGYTVAFGTKYNFRGFDLGVAGSFTFKSNRSSLYQSPTIGQLRIFSASLGYRW

SEQ ID NO: 119 - protein, 510 aa, Helicobacter pylori J99
MAFQVNTNINAMNAHVQSALTQNALKTSLERLSSGLRINKAADDASGMTVADSLRSQASSLGQAIANTNDGMGIIQVADKAMDEQLKILDTVKVKATQAAQDGQTTESRKAIQSDIVRLIQGLDNIGNTTTYNGQALLSGQFTNKEFQVGAYSNQSIKASIGSTTSDKIGQVRIATGALITASGDISLTFKQVDGVNDVTLESVKVSSSAGTGIGVLAEVINKNSNRTGVKAYASVITTSDVAVQSGSLSNLTLNGIHLGNIADIKKNDSDGRLVAAINAVTSETGVEAYTDQKGRLNLRSIDGRGIEIKTDSVSNGPSALTMVNGGQDLTKGSTNYGRLSLTRLDAKSINVVSASDSQHLGFTAIGFGESQVAETTVNLRDVTGNFNANVKSASGANYNAVIASGNQSLGSGVTTLRGAMVVIDIAESAMKMLDKVRSDLGSVQNQMISTVNNISITQVNVKAAESQIRDVDFAEESANFNKNNILAQSGSYAMSQANTVQQNILRLLT

SEQ ID NO: 120 - protein, 370 aa, Helicobacter pylori J99
MAGTQAIYESSSAGFLSQVSSIISSTSGVAGPFAGIVAGAMTAAIIPIVVGFTNPQMTAIMTQYNQSIAEAVSVPMKAANQQYNQLYQGFNDQSMAVGNNILNISKLTGEFNAQGNTQSAQISAVNSQIASILASNTTPKNPSAIEAYATNQIAVPSVPTTVEMMSGILGNITSAAPKYALALQEQLRSQASNSSMNDTADSLDSCTALGALVGSSKVFFSCMQISMTPMSVSMPTVYAKYQAVATKALTSGVNPMTTPACPIGDKVLAVYCYAEKVAEILREYYIEFVKNNTNLLQNASQMILNQSGLATSTYDTQAISNISSLYNYNIVANKSFLKSHLTYLDYIKDKLKGQKDSYLTERVQTKIIVK

SEQ ID NO: 121 - protein, 1167 aa, Helicobacter pylori J99
MTNEAINQQPQTEAAFNPQQFINNLQVAFIKVDNVVASFDPNQKPIVDKNDRDNRQAFEKISQLREEFANKAIKNPTKKNQYFSSFISKSNDLIDKDNLIDTGSSIKSFQKFGTQRYQIFMNWVSHQNDPSKINTQKIRGFMENIIQPPISDDKEKAEFLRSAKQAFAGIIIGNQIRSDQKFMGVFDESLKERQEAEKNGEPNGDPTGGDWLDIFLSFVFNKKQSSDLKETLNQEPVPHVQPDVATTTTDIQSLPPEARDLLDERGNFSKFTLGDMNMLDVEGVADIDPNYKFNQLLIHNNALSSVLMGSHNGIEPEKVSLLYGNNGGPEARHDWNATVGYKNQRGDNVATLINVHMKNGSGLVIAGGEKGINNPSFYLYKEDQLTGSQRALSQEEIQNKVDFMEFLAQNNAKLDNLSKKEKEKFQNEIEDFQKDSKAYLDALGNDHIAFVSKKDKKHLALVAEFGNGELSYTLKDYGKKADKALDREAKTTLQGSLKHDGVMFVDYSNFKYTNASKSPDKGVGATNGVSHLEAGFSKVAVFNLPNLNNLAITSVVRQDLEDKLIAKGLSPQEANKLVKDFLSSNKELVGKALNFNKAVAEAKNTGNYDEVKQAQKDLEKSLKKRERLEKDVAKNLESKSGNKNKMEAKSQANSQKDEIFALINKEANRDARAIAYAQNLKGIKRELSDKLENINKDLKDFSKSFDEFKNGKNKDFSKAEETLKALKGSVKDLGINPEWISKVENLNAALNEFKNGKNKDFSKVTQAKSDLENSIKDVIINQKITDKVDNLNQAVSVAKATGDFSGVEQALADLKNFSKEQLAQQAQKNEDFNTGKNSALYQSVKNGVNGTLVGNGLSKAEATTLSKNFSDIKKELNAKLGNFNNNNNNGLENSTEPIYTQVAKKVKAKIDRLDQIASGLGDVGQAASFLLKRHDKVDDLSKVGLSANHEPIYATIDDLGGPFPLKRHDKVDDLSKVGLSREQKLTQKIDNLNQAVSEAKASHFDNLDQMIDKLKDSTKKNVVNLYVESAKKVPTSLSAKLDNYATNSHTRINSNVKNGTINEKATGMLTQKNSEWLKLVNDKIVAHNVGSAPLSAYDKIGFNQKNMKDYSDSFKFSTRLSNAVKDIKSGFVQFLTNIFSMGSYSLMKASVEHGVKNTNTKGGFQKS

SEQ ID NO: 122 - protein, 260 aa, Helicobacter pylori J99
MKTNGHFKDFAWKKCFLGASVVALLVGCSPHIIETNEVALKLNYHPASEKVQALDEKILLLRPAFQYSDNIAKEYENKFKNQTTLKVEEILQNQGYKVINVDSSDKDDFSFAQKKEGYLAVAMNGEIVLRPDPKRTIQKKSEPGLLFSTGLDKMEGVLIPAGFVKVTILEPMSGESLDSFTMDLSELDIQEKFLKTTHSSHSGGLVSTMVKGTDNSNDAIKSALNKIFASIMQEMDKKLTQRNLESYQKDAKELKNKRNR

SEQ ID NO: 123 - protein, 1218 aa, Mycoplasma pneumoniae
MKSKLKLKRYLLFLPLLPLGTLSLANTYLLQDHNTLTPYTPFTTPLNGGLDVVRAAHLHPSYELVDWKRVGDTKLVALVRSALVRVKFQDTTSSDQSNTNQNALSFDTQESQKALNGSQSGSSDTSGSNSQDFASYVLIFKAAPRATWVFERKIKLALPYVKQESQGSGDQGSNGKGSLYKTLQDLLVEQPVTPYTPNAGLARVNGVAQDTVHFGSGQESSWNSQRSQKGLKNNPGPKAVTGFKLDKGRAYRKLNESWPVYEPLDSTKEGKGKDESSWKNSEKTTAENDAPLVGMVGSGAAGSASSLQGNGSNSSGLKSLLRSAPVSVPPSSTSNQTLSLSNPAPVGPQAVVSQPAGGATAAVSVNRTASDTATFSKYLNTAQALHQMGVIVPGLEKWGGNNGTGVVASRQDATSTNLPHAAGASQTGLGTGSPREPALTATSQRAVTVVAGPLRAGNSSETDALPNVITQLYHTSTAQLAYLNGQIVVMGSDRVPSLWYWVVGEDQESGKATWWAKTELNWGTDKQKQFVENQLGFKDDSNSDSKNSNLKAQGLTQPAYLIAGLDVVADHLVFAAFKAGAVGYDMTTDSSASTYNQALAWSTTAGLDSDGGYKALVENTAGLNGPINGLFTLLDTFAYVTPVSGMKGGSQNNEEVQTTYPVKSDQKATAKIASLINASPLNSYGDDGVTVFDALGLNFNFKLNEERLPSRTDQLLVYGIVNESELKSARENAQSTSDDNSNTKVKWTNTASHYLPVPYYYSANFPEAGNRRRAEQRNGVKISTLESQATDGFANSLLNFGTGLKAGVDPAPVARGHKPNYSAVLLVRGGVVRLNFNPDTDKLLDSTDKNSEPISFSYTPFGSAESAVDLTTLKDVTYIAESGLWFYTFDNGEKPTYDGKQQQVKNRKGYAVITVSRTGIEFNEDANTTTLSQAPAALAVQNGIASSQDDLTGILPLSDEFSAVITKDQTWTGKVDIYKNTNGLFEKDDQLSENVKRRDNGLVPIYNEGIVDIWGRVDFAANSVLQARNLTDKTVDEVINNPDILQSFFKFTPAFDNQRAMLVGEKTSDTTLTVKPKIEYLDGNFYGEDSKIAGIPLNIDFPSRIFAGFAALPSWVIPVSVGSSVGILLILLILGLGIGIPMYKVRKLQDSSFVDVFKKVDTLTTAVGSVYKKIITQTSVIKKAPSALKAANNAAPKAPVKPAAPTAPRPPVQPPKKA

SEQ ID NO: 124 - protein, 1627 aa, Mycoplasma pneumoniae
MHQTKKTALSKSTWILILTATASLATGLTVVGHFTSTTTTLKRQQFSYTRPDEVALRHTNAINPRLTPWTYRNTSFSSLPLTGENPGAWALVRDNSAKGITAGSGSQQTTYDPTRTEAALTASTTFALRRYDLAGRALYDLDFSKLNPQTPTRDQTGQITFNPFGGFGLSGAAPQQWNEVKNKVPVEVAQDPSNPYRFAVLLVPRSVVYYEQLQRGLGLPQQRTESGQNTSTTGAMFGLKVKNAEADTAKSNEKLQGAEATGSSTTSGSGQSTQRGGSSGDTKVKALKIEVKKKSDSEDNGQLQLEKNDLANAPIKRSEESGQSVQLKADDFGTALSSSGSGGNSNPGSPTPWRPWLATEQIHKDLPKWSASILILYDAPYARNRTAIDRVDHLDPKAMTANYPPSWRTPKWNHHGLWDWKARDVLLQTTGFFNPRRHPEWFDGGQTVADNEKTGFDVDNSENTKQGFQKEADSDKSAPIALPFEAYFANIGNLTWFGQALLVFGGNGHVTKSAHTAPLSIGVFRVRYNATGTSATVTGWPYALLFSGMVNKQTDGLKDLPFNNNRWFEYVPRMAVAGAKFVGRELVLAGTITMGDTATVPRLLYDELESNLNLVAQGQGLLREDLQLFTPYGWANRPDLPIGAWSSSSSSSHNAPYYFHNNPDWQDRPIQNVVDAFIKPWEDKNGKDDAKYIYPYRYSGMWAWQVYNWSNKLTDQPLSADFVNENAYQPNSLFAAILNPELLAALPDKVKYGKENEFAANEYERFNQKLTVAPTQGTNWSHFSPTLSRFSTGFNLVGSVLDQVLDYVPWIGNGYRYGNNHRGVDDITAPQTSAGSSSGISTNTSGSRSFLPTFSNIGVGLKANVQATLGGSQTMITGGSPRRTLDQANLQLWTGAGWRNDKASSGQSDENHTKFTSATGMDQQGQSGTSAGNPDSLKQDNISKSGDSLTTQDGNAIDQQEATNYTNLPPNLTPTADWPNALSFTNKNNAQRAQLFLRGLLGSIPVLVNRSGSDSNKFQATDQKWSYTDLHSDQTKLNLPAYGEVNGLLNPALVETYFGNTRAGGSGSNTTSSPGIGFKIPEQNNDSKATLITPGLAWTPQDVGNLVVSGTTVSFQLGGWLVTFTDFVKPRAGYLGLQLTGLDASDATQRALIWAPRPWAAFRGSWVNRLGRVESVWDLKGVWADQAQSDSQGSTTTATRNALPEHPNALAFQVSVVEASAYKPNTSSGQTQSTNSSPYLHLVKPKKVTQSDKLDDDLKNLLDPNQVRTKLRQSFGTDHSTQPQPQSLKTTTPVFGTSSGNLSSVLSGGGAGGGSSGSGQSGVDLSPVEKVSGWLVGQLPSTSDGNTSSTNNLAPNTNTGNDVVGVGRLSESNAAKMNDDVDGIVRTPLAELLDGEGQTADTGPQSVKFKSPDQIDFNRLFTHPVTDLFDPVTMLVYDQYIPLFIDIPASVNPKMVRLKVLSFDTNEQSLGLRLEFFKPDQDTQPNNNVQVNPNNGDFLPLLTASSQGPQTLFSPFNQWPDYVLPLAITVPIVVIVLSVTLGLAIGIPMHKNKQALKAGFALSNQKVDVLTKAVGSVFKEIINRTGISQAPKRLKQTSAAKPGAPRPPVPPKPGAPKPPVQPPKKPA

SEQ ID NO: 125 - protein, 1300 aa, Mycoplasma pneumoniae
MGYKLKRWPLVAFTFTGIGLGVVLAACSALNTSNLFPRQNRSKQLIGFTENNIIKPEAVLKAALAEDNGTETILRVNFGEALKSWYQNNKDRNIATRLTIFSENVEDEHDNLLDQKQQAEPINWPIELQKEYDQWGGSESSWKALKLYDRLIADFQSLIFSNIVANVQLTDGSDQFKPTTKDNLDSTSNKIKFVNSKPNDPNGEFFANLQAYLFAQWVVEENPLPLTQAFFAYQAPKDGLDSLYDQAAIGSALQLGYAFPAFREPNNGQSQGKTTFDPTPNSAQNFGDFIKAVFPEQKNGQTQQSNTSSRTGLFDWQTKWNTNGAANKLLVTKSNLRGAFKGVGLATAIIDQYEYLVGGSKTSSLPEVKVDSNKSNQNPLDSFFMEGKDAVAIRSIVSRAKIAMTDQTPGFKVNPAFVKVKQSQQNDTFYQNQRKLSGGQSGDNNSQGKHHYLQDAVRLTSSQAMAAASTGADSSSGTNVGGSSGGNSVLIPLPRSAALTHTQQQVQQTTSTLQTPVYARGDDGTYALAIDGGDYFLANNKRDFTKQADILLYRYLQAKSNNFKENGVEFSLNLLESGSLFQTWAQTGLTAKLYGALVAMMGSGQGTQVKGSVQGSSRAASVSVQTTQQNRQQSTDTQESEVVKLAKSLLKSSADLAKPFTDNPTFKKALTDIQSEYKDYLAAAGKLSEFKKDLGEVSGLQQAIIDRADKYIQLEKQAQKSAIGLGQPLPYQRASDGSYPALEKFFIPEDSAADGKVKASESGSAALVTLKTTDSQKSTNTVKQPDIKPTRENNDKKLKQLTSDVETKASSLITKWGATPQIGSQFSEIVSLKSKDNKPQTNMILALLSDVGIKWTKILNSFKEWFFTNTNDFKNNYDSEKKELKGNEYKDFNDLVKQTLYLRSWQRLTSKEKFGYYKELGSVKAQAAQSGMVSLSSSAAVANAVASSGMQKSGDQTLLELGKKAFESELEASSSDGQYKYLRFLSTLMWLVKDGAKNYKRLLQQAITVGTRAFVSWTVSYDDTATASAAAAKAQVAVLKTAQATNTQSDNPFNKFVQNPDYVQGSETNWFNDKSTPIKPDSLLESESTYNFTAEPFDDKTKSQKRSTGGTTNEKHFFGFNGLTINSPQSVSTASAGLTEQIFNNFGQLVTSSDKSGALSQYKDKATLKRLIQNTNSDAELNAFGEVLHRAVNVDTSNLGRFNSSGEPLISFDNKKKFLVDVVDKLDDVYFNKFEGYVGQTKVKMSDSSSSSQGTKTIRKPKPHHSPRTRVSRLWAMSFRLPTRTLTKFLLVEKLIRTVL

SEQ ID NO: 126 - protein, 150 aa, Mycoplasma pneumoniae
MKKLLIKPQFWFLTLGGFISSSVILVACATPSNSALQTVFKARSNQFFNGEQGSLQNALATALKDPEANKQFVAAPLLKALTAWYENNQDKQVTQFFKDTKKSVDEQYNQAVDKVVSASRNKNLFVQQDLLDSAGGVRNLKSPEVVWTAH

SEQ ID NO: 127 - protein, 726 aa, Mycoplasma pneumoniae
MQQQGETKDQYNTFGLRLVRNSVGVSVLGLDGFVKFIKGGSGGSNGGSSSAKKIDKEEQKKFLKFRAFQAKIGTFYNTNFAFSFPLNETLKGWFDKHRGLILANALVKVTLDTKEKASKALVDAFSSYKNWLSEYTPVGLATTMISFYFDQMKALNNKLLERVRSLNQNVNQANPTPWLNGLSAKLPYVNTNGNYEKLNNYFTFLITKVLWPKVGTEDTNVSEEKSKLKTKTEDVNKIREKILNNIDSKLKTFVQKLKPTLAPRPAYSNVILLNINNDKVWSAGANWSLAVLLDPKKVNPLSFMLLKQMFDQNSLFKKAKTLFENIQNKAKTSGSGKSGTTTNDDADALSKVIGNYYYNTWAKLTDKSIYGNLKDDKFDDLFKLAFDSSINEKSFNVDYKAVIEHYRFIYTLEWLVDKNLKNFKDLLKANLKFGEIAFIAYKNTETQNFSNPQGIFGSYFNYENETNAAKSATQIIDPNSFFYKTTTKPEAKTTQSANTAVMVQNTQMNNQQTNSYGFTGLSTSSGSMLGAATQQAILDQITKTSLQQYGSQADLKKIIGETKNQLLLDRIANQLIALKPNTSGNSGTQKTIAAYFQTDAVGNPTLDFKAKQKLLLDVLDQYKDFFGNNAQAVQRDSGKSGTGNYLTYTDGSDKITYLQFSYKDIDGLSLSSSNGTSSKFASDVVAALLLFQAAYKGTQQLALSSINKPQLPIGDKRIKTGIDLLK

SEQ ID NO: 128 - protein, 237 aa, Mycoplasma pneumoniae
MKSFLRKPKFWLLLLGGLSTSSIILSACATPSNSALQAVFKPTSNQFFNGEHGTIQSALNTALRDPETNKKFVAAPLLKALEAWYENNQDKNITQFLKDTKTNVDNQYKTVVDKVVSAPRNKSLFVQQDLLDSSGGSEATWKARKLFEQLISDFASRVFQKNYLSYKENGKVSAGPFLYDTISKNSNWQNIVFDAVNFPETNDDFFAKIQSEVFDQWAEYTDPTIISSVTLKYSAPN

SEQ ID NO: 129 - protein, 572 aa, Mycoplasma pneumoniae [sequence omitted]

SEQ ID NO: 130 - protein, 1244 aa, Mycoplasma pneumoniae
MKKFLRKPQFWLLTLGGFLSTSVILAACATPSNSALQTVFKARSSQFFNGEQGSLQSALTTALKNPVANKQFIAAPLLKALEAWYENNEDKKITQFLKDTKSNVDSQYTTAVDKVVSASRNKSLFVQQDLLDNAGGSEATWKAQKLLEQLISDFASRVFQKNYLNYKKDGQVSTGPFTYDELHKEESWKNFEFSAPRFSETNDDFFAKIQSQVFDQWVEYTDPTLISQVNYKYSAPSQGLGQIYNREKLKDKLTPSYAFPFFAEEKDIAPNQNVGNKRWKQLVKGEGAITDNNIGQSGTNSQKTGLLKYRNESNKGDFLDFPLNLSDTNETKQLVDASNIVDQLEAANLGAALNLKLQVFEQDNDELPQIKELKEDLNNTIVVDKSKDVEKASKTNALFYNDQEGKQQQSDSDPIAGALDDIFAQNTSEGTNLSKLAEQVKKAAATKMEAKTAVLRTNNSKGQQNNYVVLDAAIPTFNSTTSKSKNNSASNEVLVALKSGSINLRQVQQTDQNSYSPIKFRIVRNSTGVTVFGLDGGSYYLKQDSTNKKSVSKQSLTLLTKSSSGNSNKVLRDLDKQKQFLKFRAFQAKTNTFYSTNFAFSFPLNETLKSWFDKHRELILANALVNASLDQKDKASKALTEAFNPYKELIKEFAPVALATTMISFYFDQMKALNNKLLERARNLNQNVNQANPTPWLNGLSAKLPYVNTNGNYEKLNNYFTFLITKTLWPKVGQEETSISEESNKLKTKTADVDKIRDKILENIQTKVNDFVKNKLKPALAPRPAYSNVILLNVNNDKVLSSGANWSLASLLQSDKVNPLSFMLLKQAFDNNDLFKKAQKLFKDIQEKSSNNGGMQSSSTTNSDADALSKVIGNYYYTTWAKLTDKSIYGNPKDNKFDELFKLAFEASIDEKSFNVDYKAVIDHYRFIYTLQWLVDQKLKNFKSLLKTNLKFGEVAFIAYKNTETTNFSNPQGVFGSYFNYENSASEVKESTQTLDPNNFFYKTTTKPTVQAIQQVASLALVQKQQMQQNSTDHYGFTGLSTSTSSMFDASSRDAILQQITKTSLQQYGSKDQLKKIIQGTNNQLLLDRIAVQLSGLNPSTTNGGSGKTIATYFQVDAVGNPTLDFQAKRKLLLDLLDQYQNYFGNGAQKSQRDSTPSGTGNYLTYQNGSDKYTYTQFTYQDIDSLSLTTTSGTNNKIASDVVAALLLFQAADKGTQQLALSAINKPQLNIGDKRIESGLKLLK

SEQ ID NO: 131 - protein, 322 aa, Mycoplasma pneumoniae
MVGSGAAGSASSLQGNGSNSSGLKSLLRSAPVSVPPSSTSNQTLSLSNPAPVGPQAVVSQPAGGATAAVSVNRTASDTATFSKYLNTAQALHQMGVIVPGLEKWGGNNGTGVVASRRDATSTNLPHAAGASQTGLGTGSPREPALTATSQRAVTVVAGPLRAGNSSETDALPNVITQLYHTSTAQLAYLNGQIVVMSSARVPSLWYWVVGEDQESGKATWWAKTELNWGTDKQKQFVENQLGFKDDSNSDSKNSNLKTQGLTQPAYLIAGLDVVADHLVFAAFKAGAVGYDMTTDSNASTYNQALVWSTTAGLDSDGGTRLW

SEQ ID NO: 132 - protein, 385 aa, Mycoplasma pneumoniae
MPVFLKLTHTIRKVLRVARLSRLALLSLTAVIFSGCANINLISAVGSSSVQPLLSKLSSHYVLNHNDKDNLVEISVQAGGSSAGVKAITKGLADIGNVSKNTKSYAEENKQLWMDKKLKTITLGKDAIAVIYKAPSEFKGKLVLTKDNLNDLYDLFAGSKSVDINKFVENGQTTKNSNHNLIGFPRTGGAFASGTAEAFLKFSGLTQTKTLDKDSKEILEGQRNYGPNARPTSETNIEAFNTFVTTLRQPNLYGMVYLSLGFVNNNMNLIKSEGFEVLKVKYDNNAVTPSSQAVSSNTYKWVRPLNSVVSLLPKQKTLPSIQRFFNWLLFSNNSEIKKIYDDFGVLELTADEKKKMFKTGNAEMSNIANFWVDDYSLNNQTFGAL

SEQ ID NO: 133 - protein, 3300 aa, Mycobacterium tuberculosis H37Rv
MSFAVLPPEINSARLYVGAGLAPMLDAAAAWDGLADELGSAAASFSAVTAGLAGSSWLGAASTAMTGAAAPYLGWLSAAAAQAQQAATQTRLAAAAFEAALAATVHPAIISANRALFVSLVVSNLLGQNAPAIAATEAAYEQMWAQDVAAMFGYHAGASAAVSALTPFGQALPTVAGGGALVSAAAAQVTTRVFRNLGLANVGEGNVGNGNVGNFNLGSANIGNGNIGSGNIGSSNIGFGNVGPGLTAALNNIGFGNTGSNNIGFGNTGSNNIGFGNTGDGNRGIGLTGSGLLGFGGLNSGTGNIGLFNSGTGNVGIGNSGTGNWGIGNSGNSYNTGFGNSGDANTGFFNSGIANTGVGNAGNYNTGSYNPGNSNTGGFNMGQYNTGYLNSGNYNTGLANSGNVNTGAFITGNFNNGFLWRGDHQGLIFGSPGFFNSTSAPSSGFFNSGAGSASGFLNSGANNSGFFNSSSGAIGNSGLANAGVLVSGVINSGNTVSGLFNMSLVAITTPALISGFFNTGSNMSGFFGGPPVFNLGLANRGVVNILGNANIGNYNILGSGNVGDFNILGSGNLGSQNILGSGNVGSFNIGSGNIGVFNVGSGSLGNYNIGSGNLGIYNIGFGNVGDYNVGFGNAGDFNQGFANTGNNNIGFANTGNNNIGIGLSGDNQQGFNIASGWNSGTGNSGLFNSGTNNVGIFNAGTGNVGIANSGTGNWGIGNPGTDNTGILNAGSYNTGILNAGDFNTGFYNTGSYNTGGFNVGNTNTGNFNVGDTNTGSYNPGDTNTGFFNPGNVNTGAFDTGDFNNGFLVAGDNQGQIAIDLSVTTPFIPINEQMVIDVHNVMTFGGNMITVTEASTVFPQTFYLSGLFFFGPVNLSASTLTVPTITLTIGGPTVTVPISIVGALESRTITFLKIDPAPGIGNSTTNPSSGFFNSGTGGTSGFQNVGGGSSGVWNSGLSSAIGNSGFQNLGSLQSGWANLGNSVSGFFNTSTVNLSTPANVSGLNNIGTNLSGVFRGPTGTIFNAGLANLGQLNIGSANLGDFNLGSGNVGSFNVFSGNQGSYNIGPANLGNYNIGFANLGNYNIGFGNAGDFNQGFANTGNNNIGFANTGNNNIGIGLSGDNQQGFNFAGGWNSGTANIGLFNSGTNNVGIGNSGTGNWGIGNSGSGNTGIGNTGSTNTGFFNTGIVNTGVANAGSYNTGWYNTGDTNTGIANLGDFNTGFYNTGNFSTGFANQGDIATGAFITGDMGNGAFWRGDQQGLFSAGYRVHVPEIPAHVTVEVPVNIPITASFTNTVYSGITLEQINFGFTIDIAGIPLLAGAISKAVLPPITGTGPAITVNIGDPGGSTAIRIPATASVGPFDVTFVNIAATTGFFNATTDPSSGFFNGGPGTVSGIANIGANISGFQNVANSATSGFNNYGSLQSGLANLGDTVSGVFNTGIGAPANVSGMFNIGSNLAGFFHDQATGMSMFNLGLGNIGQFNVGFSNVGDSNAGLANIGSFNLGSGNLGSFNVFGGNQGSYNIGPANLGNYNIGLGNLGSYNFGFGNAGDFNLGFANTGNNNIGFANTGNNNIGIGLSGDNQQGFNFAGGWNSGSGNSGLFNSGTNNIGLFNSGTGNIGIGNSGTGNWGIANTGDTNTGIFNTGDVNTGLLNAGNVNTGIFNTGHYNTGSFNAGSFNTAGFNPGSYNTGYLNTGSYNTGLANSGDVNTGGFITGNYSNGFWWRGDYQGLAGISQTITVPDTAVPVKLHVPIFLDIPVTGTLGTFTVHGFRFPEITGDIFLIGIPFNAATLDAFSFPNISIVLPNIGINLGSGPDPLIDIAGTGGLLPIKIPLIDIPAAPGFGNSTTTPSSGFFNAGTGTVSGVGNVGSNSSGFFNLTSGSSGISGVQNFGELISGGFNFGNTVSGLVNASTLGLSMPANLSGGGNVGATVAGFVNNTQILNLGFGNVGSGNVGHGNIGDSNVGLGNLGNANVGHGNIGSFNVFSGNRGSYNIGPANLGNYNIGLGNLGSYNFGFGNAGDFNLGFANSGSNNIGFANTGNNNIGIGLSGHNQQGFGSWNSGTANTGLFNSGTNNIGLFNSGTGNIGIGNSGIGNTGIGNPGVGNTGLGNSGTGNWGLWNPGTGNMGVANVGTYNTGGYNVGSTNTGIANVGIANTGSYNTGSTNTGSFNDGDFNTGFYNTGDYNTGFYNTGDVNTGAFIGGNFSNGAFWQSDHQGQWGAHYAITVPQIPLLNFSLNIPVNIPIHLDFGTLAVNGFQIPAITLRALGVTHFSVGPIIVPRIAGTLPVIDINIGDPGGSSSIPITITSGAGPVVIPLLDIPPAPGFGNSTTGPSSGFFNSGTGSSSGFGNVGANNSGFWNTAFAGIGNSGLQNFGSLQSGWANLGNTVSGFYNTSAADFATPANLSGLSNVGADLTGVLRGPNGSTFNAGLANLGQFNVGSANLGSANLGSANLGSANLGNSNVGFGNIGNANIGGANIGDFNVGIANTGPGLTAAVNNIGIGNTGNYNIGVGNTGNYNIGFGNTGNNNIGIGLSGDNQIGFGPLNAGIANMGLFNLGDNNFGMANAGNFNQGIANTGNNNIGLFNTGNNNVGIWLTGDGLSGFSSLNSGAGNTGFFNSGTANTGLFNSGTGNTGLFNSGTGNVGIGNMGTGGFGVGLSGDSQVGIGGTNSGSFNIGLFNSGTGNVGIGNSGTGNVGIGNTGTGNTGIGNSGNYNTGLLNAGLVNTGIANPGNHNTGLFNIGTFNTGIANPGHYNTGSYNTGSYNTGMANAGDYGTGAFITGSMNNGLLWRADRQGLLAANYTITIERPAAFLNVDIPVNIPITGDITNVSIPAITFPRIDASGSVDIGILSGTVLAPVGPITLHGGDASAPLDTPIEIDFGPSPAINLNIGKPDGSTVINIVGGAGAGPISIPIIDLRPAPGFFNATTGPSSGFLNWGAGSASGLLNFGNNSGLYNFATSSMGNSGFQNYGSLQSGWANLGNSISGIYNTGLGAPANVSGLLNIGTNLAGWLQNGPTETTFSVGLANLGFWNLGSANIGNYNLGSANIGVYNLGSANIGDFNLGSANIGDFNLGSANIGSSNIGFGNVGPGLTAAIGNIGFGNTGNGNIGIGNTGTGNIGFGNTGNGNIGIGLTGDTMTGFGGWNSGTGNIGLFNSGTGNIGFGNSGTGNWGIGNSGDYNTGIGNTGSTNSGFFNTGLVNTGIGNSGDYNTGLFNAGNTNTGSFNPGDYNTGGFNPGNYNTGYFNPGNSNTGIANSGDVNTGAFNSGNYSNGFFWRGDYQGLGGFAYQSAVSEIPWSYDRFQH

SEQ ID NO: 134 - protein, 2204 aa, Mycobacterium tuberculosis H37Rv
MNLVSTTSGMSGFLNVGALGSGVANVGNTISGIYNVGTSDLSTPAVNSGLANIGTNIAGLLRDGAGTAAINLGLANHGNLNVGFASLGGFNFGGATIGHNNVGIGNTGIFDVGLANLGSYNIGFGNLGDDNLGFGNFGSYNIGFGNVGNDNLGFANAGGGNIGFANTGSNNVGFGNTGSNNVGIGLTGNGQIGFGSFNSGSGNIGLFNSGSNNIGFFNSGSGNFGIANSGSFNTGIGNTGNTNTGLFNSGDVNTGAFNPGSFNTGSFNTGSFNTGGFNPGNTNTGYLNIGNYNTGIANTGDVDTGAFITGNYSNGLFLSGDYQGLVGLNLVIDMPLPISLGVNIPIDIPITASAGNITLMGVTIPPTGDIVLSSIAGQRAHFGPITIPNITVVGPTTTVAIGGPNTAITITGGGAIRIPLISIPAAPGFGNSTTNPSSGFFNTGAGGASGFGNFGGANSGFWNLASATSGASGLLNVGALGSGLANVGTTVSGFYNTSTSDLATPAFNSGLANISTSIAGLLRDSTGTMVLNLGLANHGTLNVGIANLGDYNIGFANLGSANFGSANIGGNNIGGANTGIFDIGLANLGSYNIGFGNFGDDNLGFGNLGSYNVGFGNLGNDNLGFANTGSNNIGFANTGSNNIGIGLTGDGQIGFGSLNSGSGNIGLFNSGSGNIGFFNSGNGNVGIGNTGTANFGLGNTGSTNTGFFNSGDVNTGIGNTGSFNTGSFNPGDSNTGDFNPGSYNTGLGNTGDVDTGAFISGSYSNGFLWSGNYQGLIGLHAALAIPEIALTFGVDIPIHIPINIDAGVVTLQGFSIVAAENNIDFTPIIIPTINITLPTAAITVGGPTTSIGITASAGIGSITIPIIDIPATSGFGNSTTSPSSGFFNSGAGSASGFLNVVAGASGISGYLNVGALGSGVTNVGHTVSGFYNASALDLVTPAFASGLMRDGMGTMTLNLGLANLGSNNAGFGNTGIFDVGVANLGNYNIGFGNFGDDNLGFANLGSYNIGVANTGSNNIGFANTGSNNIGIGLTGTGQIGIGALNSGSGNIGLFNSGDGNIGFFNSGTGNFGIGNTGTGNFGIGNSGSTSTGLFNSGDGNTGGFNPGNFNTGNFNTGSFNTGGFNAGNTNTGHFNTGNYNTGIANTGDVSTGAFISGNYSNGILWRGDYQGLIGYSYALTIPEIPAHLDVNIPIDIPITGSFTDLVVDNFTIPIIGFESFAFSFHIHTEPDIGPIIVPSFVLSVPTFAIAVGGPTTAINISATAGLGPITIPIIDIPAAPGIGNSTTSPSSGFFNTGAGTASGFGNVGGNTSGLWNLASAASGVSGLLNVGALGSGVANVGNTISGIYNTSPLDLGTPAFGSGLANIAGLLQGGAGTTILDLAGLGNLNVGLANLGGSNFGIGNTGIFNVGFANVGNHNIGLANLGNYSVGFANSGNYHIGIANTGSANIGFANTGSGNIGIGLTGTGQIGFGSFNSGSHNIGLFNSGDGNVGFFNSGTGNVGIGNTGTANFGIANSGSFNTGLGNTGSTNTGLFNPGNVNTGVGNTGSINTGSINTGSFNTGSTNTGSFNLGDHNTGSFNSGDYNTGYFNAGDYNTGVANTGNVNTGAFISGNYSNGFFWRGDYQGLIGLSTTITIPEIPYRYDLSVPIDIPITGTVVATTPNSFTIPGFQIRVLLGPAAVLVNEMIGPITIDVNQVIAIDSPIQQTISMVGTGGFGPIPIGISIGGTPGFGNSTTGPSSGFFHTGAGHVSGFGNFGAGNMSGSGNFGAGNSGFFNAGGLGNSGLLNFGALQSGLANLGNTISGVYNTSTLDLATPAFGSGIANIGANLAGLFLDNTGNLTLNFGVANQGGLNAGIGNLGSVNIGFVNTGDSNLGIGNLGDLNFGGVNIGGNNIGIANTGIFDIGLANLGSYNIGLANLGDDNLGFGNAGSYNIGFANFGSDNLGFANTGSYNIGFANTGNNNIGVGLTGNGQIGIGSLNSGSNNIGLFNSGSGNIGFFNSGTGNVGIFNTGTGNFGLANSGGFNTGIGNAGSTNTGVFNPGDLNTGSFNPGSFNTGGFNPGSGNTGYLNTGDYNTGVANTGDVDTGAFITGSYSNGFLVSGDYQGLIGLPLLGIPVTPGYFNLTGGPSSGFFNSGAGSVSGFVNSGAGLSGYLNTGALGSGVANVGNTISGWLNASALDLATPGFLSGIGNFGTNLAGFFRG

SEQ ID NO: 135 - protein, 1901 aa, Mycobacterium tuberculosis H37Rv
MSFVLIAPEFVTAAAGDLTNLGSSISAANASAASATTQVLAAGADEVSARIAALFGGFGLEYQAISAQVAAYHQRFVQALSTGAGAYASAEAAAAEQIVLGVINAPTQALLGRPLIGDGANATTPGGAGGAGGLLFGNGGAGAAGAPGQAGGPGGPAGLWGNGGPGGAGGSGGGTGGAGGAGGWLFGVGGAGGVGGAGGGTGGAGGPGGLIWGGGGAGGVGGAGGGTGGAGGRAELLFGAGGAGGAGTDGGPGATGGTGGHGGVGGDGGWLAPGGAGGAGGQGGAGGAGSDGGALGGTGGTGGTGGAGGAGGRGALLLGAGGQGGLGGAGGQGGTGGAGGDGVLGGVGGTGGKGGVGGVAGLGGAGGAAGQLFSAGGAAGAVGVGGTGGQGGAGGAGAAGADAPASTGLTGGTGFAGGAGGVGGQGGNAIAGGINGSGGAGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGVGADNPTGIGGTGGTGGKGGAGGAGGQGGSSGAGGTNGSGGAGGTGGQGGAGGAGGAGADNPTGIGGAGGTGGTGGAAGAGGAGGAIGTGGTGGAVGSVGNAGIGGTGGTGGVGGAGGAGAAAAAGSSATGGAGFAGGAGGEGGAGGNSGVGGTNGSGGAGGAGGKGGTGGAGGSGADNPTGAGFAGGAGGTGGAAGAGGAGGATGTGGTGGVVGATGSAGIGGAGGRGGDGGDGASGLGLGLSGFDGGQGGQGGAGGSAGAGGINGAGGAGGNGGDGGDGATGAAGLGDNGGVGGDGGAGGAAGNGGNAGVGLTAKAGDGGAAGNGGNGGAGGAGGAGDNNFNGGQGGAGGQGGQGGLGGASTTSINANGGAGGNGGTGGKGGAGGAGTLGVGGSGGTGGDGGDAGSGGGGGFGGAAGKAGGGGNGGRGGDGGDGASGLGLGLSGFDGGQGGQGGAGGSAGAGGINGAGGAGGNGGDGGDGATGAAGLGDNGGVGGDGGAGGAAGNGGNAGVGLTAKAGDGGAAGNGGNGGAGGAGGAGDNNFNGGQGGAGGQGGQGGLGGASTTSINANGGAGGNGGTGGKGGAGGAGTLGVGGSGGTGGDGGDAGSGGGGGFGGAAGKAGGGGNGGVGGDGGEGASGLGLGLSGFDGGQGGQGGAGGSAGAGGINGAGGAGGTGGAGGDGAPATLIGGPDGGDGGQGGIGGDGGNAGFGAGVPGDGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGVGGNAGAGGINGAGGTGGTGGAGGDGQNGTTGVASEGGAGGQGGDGGQGGIGGAGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGVGGNAGAGGINGAGGTGGTGGAGGDGQNGTTGVASEGGAGGQGGDGGQGGIGGAGGNAGFGAGVPGDGGIGGTGGAGGAGGAGADGDPSIDGGQGGAGGHGGQGGKGGLNSTGLASAASGDGGNGGAGGAGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDGS

SEQ ID NO: 136 - protein, 1329 aa, Mycobacterium tuberculosis H37Rv
MSLVIVAPETVAAAALDVARIGSSIGAANAAAAGSTTSVLAAGADEVSAAIATLFGSHAREYQAISTQVAAFHDRFAQTLSAAVGSYVSAEATNAAPLATLEHNVLNALNAPTQALLGRPLIGDGAAGAPGTGQAGGAGGILWGNGGAGGSGAPGQVGGAGGAAGLFGTGGAGGAGGAGAAGGAGGSGGWLLGNGGVGGAGGQSLLGGATGGAGGNAGLFGVGGTGGPGGPGGPGGVGGTGGAGGLGGTLYGAGGHGGAGGPGPIGGVGGHGGVGGAAGLLGVGGHGGAGGHGAEGVAGAAGEDLSPHGTSGGVGGDAGDGGTGGRGGWLAGAGGAGGAGGVGGTGGAGGAGFSRALIVAGDNGGDPGAGGAGGTGGAGSTIGAHGAAGASPTSGGNGGAGGNGAHFSSGGKAGGNGGAGGAGGLVGNGGAGGAGGNGAPGAPPSGGDPNGGGGGAGGAGGKGGDGGAQAGDGGAGGAGGKGGNGGNGATGATGLNGLGAGADGTDGGKGGNGGAGGGGGAGGQGGKALAATHQDGSMGAGGAGGNGGAGGMGGDGGNGAKGTFDNGGDGVGGNGGNGGSRGIGGAGGIGGAGSTAGADGARGATPTSGGNGGTGGNGANATVAGGAGGAGGKGGNGGLVGNGGAGGKGGDGMAGVAGSSPTTAGESGTSGQNGGAGGAGGAGGRGGDFGGDGGTGGAGGNGANGANATTPGAKGGDGGHGGPGAQGGNGGQGGPGGLAGNLFGQNGIQGVGGSGGKGGAGGLAGDGGNGANGNFAFGDGNGGHGGNGGNPGAGGQGGSGGAGSTPGAKGAHGFTPTSGGDGGDGGNGGNSQVVGGNGGDGGNGGNGGSAGTGGNGGRGGDGAFGGMSANATNPGENGPNGNPGGNGGAGGAGGAGLNGGNGGAGGNGGLGGFGGNGAAGANGVAVGAPGQPGGAGGHGGAGGNGGAGGNGGQGVVSDGAGGAGGAGGDGGAPGDGANGGNGQGAGAFAGGGGGRGGDGGNAGNAGAGGPGGTGSTAGKAGPAGSILHDGGNGGHGGHGAASGGNGGPGGHGGNGGNGGTGANGGNGGIGGTGGAGSTGAKGVLGTNEGDGGDGGRGGNGGRGGNGGQGLTGAGGNGGTGGTPGNGGNGGNGASGDLVTSPGDGGGGGRGGDAGRGGDAGLGGSSGPGGTPGDWGTGGTGGTGGTGGQGANGGLTGGRGGTGGNGGNGNTGGTGGAGGTGGTGHNGSQPGMGGNGGAGGFGGNGFAGVGGRGGMGGSGGTGGTGDAGPFGTGTGGTGGHGGQGGGGGFSILLGLGGLGGLGSPGSIATGTAGGAGGGGGFGGLGGGEFV

SEQ ID NO: 137 - protein, 1660 aa, Mycobacterium tuberculosis H37Rv
MSYVIATPEMMATAAFDLARIGSQVSAASAVAAMPTTEVVAAGADEVSAGIAALFSAHAQEYQALSAQAAAFHDQFVHTLTAAARWYTATEIANAAAMRVVLGAVNAPTQTLLGRPLIGDGAHGTAPGQPGGAGGLLFGNGGNGAAGAVGQVGGAGGAAGLFGIGGAGGAGGAGAPGGTGGTGGWLAGGGGVGGMGGAGGGAGGAGGNAGLFGNGGAGGAGGAGGGAGGAGGNAGWFGHGGAGGVGGVGAAGANGATPGQDGAAGVAGSDDGAGGDGLAGSDGGDGGAGGVGGNGGRGGWLLGNGGAGGVGGVGGAGGAGAAGGAGGAGATGINGPAGISAAGGDGGAGGNGGAGGNGGVGGAGGAGGSAGLLGYVGRAGDGGAGGGGGLGGAPGDGGAGGNGGSWLAAGDGGAGGHGGDPGLGGAGGAGGASGGAGARAGANGLAAGNDGPVSGGNGGKGGNGAHAPVAGGHGGNGGAGGNGGLVGDGGAGGHGGDGAAGAGYADMTAIFLGSSGTPGEDGGNGGAGGAGGAGGAHAGDGGAGGAGGNGGAGGAGGNGAHGFNAVLVSDGGNGGDGGAGGRGGDGGAGGAGGDAPAGRAGSQGVGGDGGAGGAGGAPGNGGSGGRGDMAFKDGDGGAGGDGGDPGAGGKGGAGGAGATEGVTGATGATVHSGGNGGKGGNGADATVAGANGGKGGAGGNGGLVGDGGAGGDGGSGAAGANGANVGEDGADGTLSGQPGEGSEANGGQGGVGGGGAGGAGGDGGAGSSALGSGGNGGRGDAGQAGGAGGAGGAGGAGGSVSGDGGPGGKGGAGGAGGAGASGGGGGKGASGADSAEAVGGAGGKGGDGGVGGVGGDGGPGGDGGAGGAAPAGQVGSHGVGGVGGDGGLGGAGGNGGDGGHGSDGGDGGDGGDPGAGGLGGLGGDSGNGTRAASGVDASDHGPGSGGNGGNGGNGAQASVAGGAGGNGGDGGNAGRVGDGGAGGNGGDGAAGANGANSGAPGSDALALGQPGGNGGQGDAGQAGGAGGAGGAGGAGGSVSGDGGAGGNGGAGGNGGVGASGGAGARGANGIDSIGGTGGAGGGGGDGGAGGVGGHGGDGGVGGAAPSGTVGSHGTGGVGGDGGLGGAGGVGGAGGNGGIGITVGGAGGAGGNGGDPGAGGRGGLGGDSGNGTSAANGVDASKHGPLTGGDGGVGGNGAKAAAAGGDGGQGGDGGNAGLFGDGGAGGDGADGTAAEALGGDGGAGGAGGKGGDAGDIGDGGDGGKGGDGAHGALGGLTVAGGNGGAGGAGGAGGAGGAFLGDGGNGGAGGQGGAGRGGSPGGGGGVGGHGGAGGDAGMNGGGGTGGQGGNGAAGGAGWSPDSDLKGFDGFDGGSGGAGGDGGAGGAGGTQTGDGGDGGAGGLGGAGGVGGNGVDGFDINETTGRDGGDGGDGGYGGWGGAGGNGGAGGSAPAGEVGNRGVGGDGGDGGSGGDAGNGGLGGDGFTYLADFDGEPGGDGGDGGDGGWGRPGGQGGFGSTSGAHGKAGFGAPGGDGGDGGNGGHGGDGNGSFADAGDGGPGGNGGNGGLGGAGRDGGAPGGDGGDGGTGGSGGFGAPPPRSIGGGDGGDGGRGGDGGRGAGGLTSGGVGSSGESGGSGNGRGDPGSGGSGGEGGEGGPSISVNVT

SEQ ID NO: 138 - protein, 1381 aa, Mycobacterium tuberculosis H37Rv
MSFVLVSPETVAAVATDLKRIGASLAHENASAAASTTAVVSAAADEVSTAVAALFSQHAQGYQAAAAQVAAFHSRFVQALTAGAGAYAFAEAANASPLQSAMGAVSASAQTLLSRPLIGNGANATTPGGNGGDGGWLFGSGGNGAPGAAGQSGGNGGSAGLWGNGGAGGAGGSGGAAGGNGGNGGWLFGAGGTGGIGGTGAPGAMGGTGGNGGNGALLIGGGGLGGAGGMGGTGGGTGGTGGNGGNGALLIGAGGVGGAGGIGGQGTGAGGAAGAGGTGGNGGAGGLFMNGGDGGAGGQGGDGAAGDAAASAGGTGGKGGQGGDGGTGGAGGAGPVLFGHGGAGGMGGQGGTGGMGGAGGDGTTVIAAGTGGEGGTGGAAGAGGAAGARGALTSGGLAGGVGAGGTGGTGGTGGNGADAAAVVGFGANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNGGNGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGQGGNAGQGGAGGAGGNAVIPGDGVGKAPHGDAGGSGGDGGKGGQGGSGGTGGSGAPIGGGAGGTGGSGGHAGKGGAGGIGAQGTTITVPGNGGNAGDGGNGGNAGAGGNGGSGDFGGNTTSGASGSGGNGGNAGTAGSGGAGGTGGTGLSGGNGGNGGNGGNGGDGGNGAHGTVGAQFVPATSLPTPNGGAGGNGGTGSNGGAPGPAGAPGPTTGGNAGSQGIGGDGGNGGDGGKGGDGADAVNVVFMPTEPQAATGTAGSAGDPTGGNGGPGTPGSPMVAPPPPTPITQVQQGGDGGAGGTGSTNANDGTATGGKGGEGGVGSILGGPGGNGGTGGNASATGTNGVANAGNGGKGGDGGQFGAGGNGGAGGSVTDGSAGSTAGNGGNGGNATNGTIAGQPAGGNGSAGGKGGDGGNIAAGATGTAGNGGNGGNGNDGAVNAGTGGSGGNGGNAGGGGANGGDGGAGGAGGAGGRGGKGIDGGFGGDGGNGGSNNGTGAGGNGGNGGTGGVGSVGAAGGDGGNGGTGGFAGFGGTAGNGGSGGTGGAGGDGGTGGDGGNGVIAGGGGTGGNGGASGAGGAGGTGGFAGNGNAGGNGGTGGASEDGDNGNAGSGATGGTGGNGGTGGDGGAAGLGGVA

SEQ ID NO: 139 - protein, 1306 aa, Mycobacterium tuberculosis H37Rv
MSFVIATPEMLTTAATDLAKIGSTITAANTAAAAVAKVLPASADEVSVAVAALFGTHAQEYQTVSAQVATFHDRFVQTLSAAASSYVAAEAVNVEQSLLAAVNAPTQALFGRPLIGNGADGSPGTGQAGGPGGILYGNGGNGGSGAPGQRGGAGGAAGLIGNGGNGGAGGVGTTGGAGGHGGAGGWLYGNGGAGGFGGAGAVGGNGGAGGTAGLFGVGGAGGAGGNGIAGVTGTSASTPGGSGTAGGAGGIGGNGGAGGAGGVLMGNGGNGGAGGEGGPGGAGGAGASGAHATNLGADGQAGGNGGNGGAGGTGGVGGPGGGHGLLGLGGSHGAGGAGGSGGDGGAPGDGGNGATGTWGHNLGAGGTGGNGGNPGAGGAGGAGGASVGGSAHGANGAPGTTSTSGGNGGDGGKGADAISSGQTGANGGRGGDGGQVGNGGAGGAGGRGGAGGLGFGSEAPGRPGGAGGTGGAGGNGGTQAGDGGTGGAGGAGGDGGSGGAGSIGFNASAPGAAGSPGGNGGNGGPGGAGGEGGAGGLALAASGQNGSQGAGGDGGAGGNGGTPGNGGHGAAGALGVNGGVGGAGGHGGDPGVGGAGGQGGSGSTPGANGAPGNTPTSGGNGGNGGRGADATGFGQTGASGGRGGDGGLVGNGGAGGAGGNGSKGLPGLGRLGNPGLDGGTGGNGGAGGSGGAWAGNGGTGGAGGTGGVGGTGGSGSDGVNGSSAGADGHPGGTGGVGGTGGKGGDGGDGGAAPNGVAGSQGPGGAGGDGGTGGVGGNGGRGIDGADGATAGARGQDGGAGGAGGKGGRGGTGGPGGAGPAGTTGSQGAGGNGGSGGTGGDPGDGGNGANGSVFTNNGIGGNGGNGGNAGPSGAGGSGGAGSTFGATGSSSSIHVNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGAGGTGGTGGDGGRGAHGTLFSSLAGTGGTGGNGGTGGTGGTGGAGGAGGTGSTLGATGATGAAGRAGNGGVGGSGGLGSAFGPGGTGGMGGAGGTSTVSAGGDGGRGGFGGDGLDASSGGNGGDGGHGGDGFRTAGAGGRGGDGGKGADPGGLFPIPGAGGKGGTGGTGGTAHLGPLAIIGQSGQPGQFGSPGADGRGGAGGAGGGGGAGGSF

SEQ ID NO: 140 - protein, 1436 aa, Mycobacterium tuberculosis H37Rv
MSAAAVAWDQLAMELASAAASFNSVTSGLVGESWLGPSSAAMAAAVAPYLGWLAAAAAQAQRSATQAAALVAEFEAVRAAMVQPALVAANRSDLVSLVFSNFFGQNAPAIAAIEAAYEQMWAIDVSVMSAYHAGASAVASALTPFTAPPQNLTDLPAQLAAAPAAVVTAAITSSKGVLANLSLGLANSGFGQMGAANLGILNLGSLNPGGNNFGLGNVGSNNVGLGNTGNGNIGFGNTGNGNIGFGLTGDNQQGFGGWNSGTGNIGLFNSGTGNIGIGNTGTGNFGIGNSGTSYNTGIGNTGQANTGFFNAGIANTGIGNTGNYNTGSFNLGSFNTGDFNTGSSNTGFFNPGNLNTGVGNTGNVNTGGFNSGNYSNGFFWRGDYQGLIGFSGTLTIPAAGLDLNGLGSVGPITIPSITIPEIGLGINSSGALVGPINVPPITVPAIGLGINSTGALVGPINIPPITLNSIGLELSAFQVINVGSISIPASPLAIGLFGVNPTVGSIGPGSISIQLGTPEIPAIPPFFPGFPPDYVTVSGQIGPITFLSGGYSLPAIPLGIDVGGGLGPFTVFPDGYSLPAIPLGIDVGGGLGPFTVFPDGYSLPAIPLGIDVGGGLGPFTVFPDGYSLPAIPLGIDVGGAIGPLTTPPITIPSIPLGIDVSGSLGPINIPIEIAGTPGFGNSTTTPSSGFFNSGTGGTSGFGNVGSGGSGFWNIAGNLGNSGFLNVGPLTSGILNFGNTVSGLYNTSTLGLATSAFHSGVGNTDSQLAGFMRNAAGGTLFNFGFANDGTLNLGNANLGDYNVGSGNVGSYNFGSGNIGNGSFGFGNIGSNNFGFGNVGSNNLGFANTGPGLTEALHNIGFGNIGGNNYGFANIGNGNIGFGNTGTGNIGIGLTGDNQVGFGALNSGSGNIGFFNSGNGNIGFFNSGNGNVGIGNSGNYNTGLGNVGNANTGLFNTGNVNTGIGNAGSYNTGSYNAGDTNTGDLNPGNANTGYLNLGDLNTGWGNIGDLNTGALISGSYSNGILWRGDYQGLIGYSDTLSIPAIPLSVEVNGGIGPIVVPDITIPGIPLSLNALGGVGPIVVPDITIPGIPLSLNALGGVGPIVVPDITIPGIPLSLNALGGVGPIVVPDITIPGIPLSLNALGGVGPIVVPDITIPGIPLSLNALGGVGPITVPGVPISRIPLTINIRIPVNITLNELPFNVAGIFTGYIGPIPLSTFVLGVTLAGGTLESGIQGFSVNPFGLNIPLSGATNAVTIPGFAINPFGLNVPLSGGTSPVTIPGFAINPFGLNVPLSGGTSPVTIPGFTIPGSPLNLTANGGLGPINIPINITSAPGFGNSTTTPSSGFFNSGDGSASGFGNVGPGISGLWNQVPNALQGGVSGIYNVGQLASGVANLGNTVSGFNNTSTVGHLTAAFNSGVNNIGQMLLGFFSPGAGP

SEQ ID NO: 141 - protein, 3716 aa, Mycobacterium tuberculosis H37Rv
MEFPVLPPEINSVLMYSGAGSSPLLAAAAAWDGLAEELGSAAVSFGQVTSGLTAGVWQGAAAAAMAAAAAPYAGWLGSVAAAAEAVAGQARVVVGVFEAALAATVDPALVAANRARLVALAVSNLLGQNTPAIAAAEAEYELMWAADVAAMAGYHSGASAAAAALPAFSPPAQALGGGVGAFLTALFASPAKALSLNAGLGNVGNYNVGLGNVGVFNLGAGNVGGQNLGFGNAGGTNVGFGNLGNGNVGFGNSGLGAGLAGLGNIGLGNAGSSNYGFANLGVGNIGFGNTGTNNVGVGLTGNHLTGIGGLNSGTGNIGLFNSGTGNVGFFNSGTGNFGVFNSGNYNTGVGNAGTASTGLFNAGNFNTGVVNVGSYNTGSFNAGDTNTGGFNPGGVNTGWLNTGNTNTGIANSGNVNTGAFISGNFNNGVLWVGDYQGLFGVSAGSSIPAIPIGLVLNGDIGPITIQPIPILPTIPLSIHQTVNLGPLVVPDIVIPAFGGGIGIPINIGPLTITPITLFAQQTFVNQLPFPTFSLGKITIPQIQTFDSNGQLVSFIGPIVIDTTIPGPTNPQIDLTIRWDTPPITLFPNGISAPDNPLGLLVSVSISNPGFTIPGFSVPAQPLPLSIDIEGQIDGFSTPPITIDRIPLTVGGGVTIGPITIQGLHIPAAPGVGNTTTAPSSGFFNSGAGGVSGFGNVGAGSSGWWNQAPSALLGAGSGVGNVGTLGSGVLNLGSGISGFYNTSVLPFGTPAAVSGIGNLGQQLSGVSAAGTTLRSMLAGNLGLANVGNFNTGFGNVGDVNLGAANIGGHNLGLGNVGDGNLGLGNIGHGNLGFANLGLTAGAAGVGNVGFGNAGINNYGLANMGVGNIGFANTGTGNIGIGLVGDHRTGIGGLNSGIGNIGLFNSGTGNVGFFNSGTGNFGIGNSGRFNTGIGNSGTASTGLFNAGSFSTGIANTGDYNTGSFNAGDTNTGGFNPGGINTGWFNTGHANTGLANAGTFGTGAFMTGDYSNGLLWRGGYEGLVGVRVGPTISQFPVTVHAIGGVGPLHVAPVPVPAVHVEITDATVGLGPFTVPPISIPSLPIASITGSVDLAANTISPIRALDPLAGSIGLFLEPFRLSDPFITIDAFQVVAGVLFLENIIVPGLTVSGQILVTPTPIPLTLNLDTTPWTLFPNGFTIPAQTPVTVGMEVANDGFTFFPGGLTFPRASAGVTGLSVGLDAFTLLPDGFTLDTVPATFDGTILIGDIPIPIIDVPAVPGFGNTTTAPSSGFFNTGGGGGSGFANVGAGTSGWWNQGHDVLAGAGSGVANAGTLSSGVLNVGSGISGWYNTSTLGAGTPAVVSGIGNLGQQLSGFLANGTVLNRSPIVNIGWADVGAFNTGLGNVGDLNWGAANIGAQNLGLGNLGSGNVGFGNIGAGNVGFANSGPAVGLAGLGNVGLSNAGSNNWGLANLGVGNIGLANTGTGNIGIGLVGDYQTGIGGLNSGSGNIGLFNSGTGNVGFFNTGTGNFGLFNSGSFNTGIGNSGTGSTGLFNAGNFNTGIANPGSYNTGSFNVGDTNTGGFNPGDINTGWFNTGIMNTGTRNTGALMSGTDSNGMLWRGDHEGLFGLSYGITIPQFPIRITTTGGIGPIVIPDTTILPPLHLQITGDADYSFTVPDIPIPAIHIGINGVVTVGFTAPEATLLSALKNNGSFISFGPITLSNIDIPPMDFTLGLPVLGPITGQLGPIHLEPIVVAGIGVPLEIEPIPLDAISLSESIPIRIPVDIPASVIDGISMSEVVPIDASVDIPAVTITGTTISAIPLGFDIRTSAGPLNIPIIDIPAAPGFGNSTQMPSSGFFNTGAGGGSGIGNLGAGVSGLLNQAGAGSLVGTLSGLGNAGTLASGVLNSGTAISGLFNVSTLDATTPAVISGFSNLGDHMSGVSIDGLIAILTFPPAESVFDQIIDAAIAELQHLDIGNALALGNVGGVNLGLANVGEFNLGAGNVGNINVGAGNLGGSNLGLGNVGTGNLGFGNIGAGNFGFGNAGLTAGAGGLGNVGLGNAGSGSWGLANVGVGNIGLANTGTGNIGIGLTGDYRTGIGGLNSGTGNLGLFNSGTGNIGFFNTGTGNFGLFNSGSYSTGVGNAGTASTGLFNAGNFNTGLANAGSYNTGSLNVGSFNTGGVNPGTVNTGWFNTGHTNTGLFNTGNVNTGAFNSGSFNNGALWTGDYHGLVGFSFSIDIAGSTLLDLNETLNLGPIHIEQIDIPGMSLFDVHEIVEIGPFTIPQVDVPAIPLEIHESIHMDPIVLVPATTIPAQTRTIPLDIPASPGSTMTLPLISMRFEGEDWILGSTAAIPNFGDPFPAPTQGITIHTGPGPGTTGELKISIPGFEIPQIATTRFLLDVNISGGLPAFTLFAGGLTIPTNAIPLTIDASGALDPITIFPGGYTIDPLPLHLALNLTVPDSSIPIIDVPPTPGFGNTTATPSSGFFNSGAGGVSGFGNVGSNLSGWWNQAASALAGSGSGVLNVGTLGSGVLNVGSGVSGIYNTSVLPLGTPAVLSGLGNVGHQLSGVSAAGTALNQIPILNIGLADVGNFNVGFGNVGDVNLGAANLGAQNLGLGNVGTGNLGFANVGHGNIGFGNSGLTAGAAGLGNTGFGNAGSANYGFANQGVRNIGLANTGTGNIGIGLVGDNLTGIGGLNSGAGNIGLFNSGTGNIGFFNSGTGNFGIGNSGSFNTGIGNSGTGSTGLFNAGSFNTGVANAGSYNTGSFNAGDTNTGGFNPGTINTGWFNTGHTNTGIANSGNVGTGAFMSGNFSNGLLWRGDHEGLFSLFYSLDVPRITIVDAHLDGGFGPVVLPPIPVPAVNAHLTGNVAMGAFTIPQIDIPALTPNITGSAAFRIVVGSVRIPPVSVIVEQIINASVGAEMRIDPFEMWTQGTNGLGITFYSFGSADGSPYATGPLVFGAGTSDGSHLTISASSGAFTTPQLETGPITLGFQVPGSVNAITLFPGGLTFPATSLLNLDVTAGAGGVDIPAITWPEIAASADGSVYVLASSIPLINIPPTPGIGNSTITPSSGFFNAGAGGGSGFGNFGAGTSGWWNQAHTALAGAGSGFANVGTLHSGVLNLGSGVSGIYNTSTLGVGTPALVSGLGNVGHQLSGLLSGGSAVNPVTVLNIGLANVGSHNAGFGNVGEVNLGAANLGAHNLGFGNIGAGNLGFGNIGHGNVGVGNSGLTAGVPGLGNVGLGNAGGNNWGLANVGVGNIGLANTGTGNIGIGLTGDYQTGIGGLNSGAGNLGLFNSGAGNVGFFNTGTGNFGLFNSGSFNTGVGNSGTGSTGLFNAGSFNTGVANAGSYNTGSFNVGDTNTGGFNPGSINTGWLNAGNANTGVANAGNVNTGAFVTGNFSNGILWRGDYQGLAGFAVGYTLPLFPAVGADVSGGIGPITVLPPIHIPPIPVGFAAVGGIGPIAIPDISVPSIHLGLDPAVHVGSITVNPITVRTPPVLVSYSQGAVTSTSGPTSEIWVKPSFFPGIRIAPSSGGGATSTQGAYFVGPISIPSGTVTFPGFTIPLDPIDIGLPVSLTIPGFTIPGGTLIPTLPLGLALSNGIPPVDIPAIVLDRILLDLHADTTIGPINVPIAGFGGAPGFGNSTTLPSSGFFNTGAGGGSGFSNTGAGMSGLLNAMSDPLLGSASGFANFGTQLSGILNRGAGISGVYNTGALGVVTAAVVSGFGNVGQQLSGLLFTGVGP

SEQ ID NO: 142 - protein, 3157 aa, Mycobacterium tuberculosis H37Rv
MNFPVLPPEINSVLMYSGAGSSPLLAAAAAWDGLAEELGSAAVSFGQVTSGLTAGVWQGAAAAAMAAAAAPYAGWLGSVAAQAVAVAGQARAAVAAFEAALAATVDPAAVAVNRMAMRALAMSNLLGQNAAAIAAVEAEYELMWAADVAAMAGYHSGASAAAAALPAFSPPAQALGGGVGAFLNALFAGPAKMLRLNAGLGNVGNYNVGLGNVGIFNLGAANVGAQNLGAANAGSGNFGFGNIGNANFGFGNSGLGLPPGMGNIGLGNAGSSNYGLANLGVGNIGFANTGSNNIGIGLTGDNLTGIGGLNSGTGNLGLFNSGTGNIGFFNSGTGNFGVFNSGSYNTGVGNAGTASTGLFNVGGFNTGVANVGSYNTGSFNAGNTNTGGFNPGNVNTGWLNTGNTNTGIANSGNVNTGAFISGNFSNGVLWRGDYEGLWGLSGGSTIPAIPIGLELNGGVGPITVLPIQILPTIPLNIHQTFSLGPLVVPDIVIPAFGGGTAIPISVGPITISPITLFPAQNFNTTFPVGPFFGLGVVNISGIEIKDLAGNVTLQLGNLNIDTRINQSFPVTVNWSTPAVTIFPNGISIPNNPLALLASASIGTLGFTIPGFTIPAAPLPLTIDIDGQIDGFSTPPITIDRIPLNLGASVTVGPILINGVNIPATPGFGNTTTAPSSGFFNSGDGGVSGFGNFGAGSSGWWNQAQTEVAGAGSGFANFGSLGSGVLNFGSGVSGLYNTGGLPPGTPAVVSGIGNVGEQLSGLSSAGTALNQSLIINLGLADVGSVNVGFGNVGDFNLGAANIGDLNVGLGNVGGGNVGFGNIGDANFGLGNAGLAAGLAGVGNIGLGNAGSGNVGFGNMGVGNIGFGNTGTNNLGIGLTGDNQTGIGGLNSGAGNIGLFNSGTGNVGLFNSGTGNFGLFNSGSFNTGIGNGGTGSTGLFNAGNFNTGVANPGSYNTGSFNVGDTNTGGFNPGSINTGWFNTGNANTGVANSGNVDTGALMSGNFSNGILWRGNFEGLFGLNVGITIPEFPIHWTSTGGIGPIIIPDTTILPPIHLGLTGQANYGFAVPDIPIPAIHIDFDGAADAGFTAPATTLLSALGITGQFRFGPITVSNVQLNPFNVNLKLQFLHDAFPNEFPDPTISVQIQVAIPLTSATLGGLALPLQQTIDAIELPAISFSQSIPIDIPPIDIPASTINGISMSEVVPIDVSVDIPAVTITGTRIDPIPLNFDVLSSAGPINISIIDIPALPGFGNSTELPSSGFFNTGGGGGSGIANFGAGVSGLLNQASSPMVGTLSGLGNAGSLASGVLNSGVDISGMFNVSTLGSAPAVISGFGNLGNHVSGVSIDGLLAMLTSGGSGGSGQPSIIDAAIAELRHLNPLNIVNLGNVGSYNLGFANVGDVNLGAGNLGNLNLGGGNLGGQNLGLGNLGDGNVGFGNLGHGNVGFGNSGLGALPGIGNIGLGNAGSNNVGFGNMGLGNIGFGNTGTNNLGIGLTGDNQTGFGGLNSGAGNLGLFNSGTGNIGFFNTGTGNWGLFNSGSYNTGIGNSGTGSTGLFNAGSFNTGLANAGSYNTGSLNAGNTNTGGFNPGNVNTGWFNAGHTNTGGFNTGNVNTGAFNSGSFNNGALWTGDHHGLVGFSYSIEITGSTLVDINETLNLGPVHIDQIDIPGMSLFDIHELVNIGPFRIEPIDVPAVVLDIHETMVIPPIVFLPSMTIGGQTYTIPLDTPPAPAPPPFRLPLLFVNALGDNWIVGASNSTGMSGGFVTAPTQGILIHTGPSSATTGSLALTLPTVTIPTITTSPIPLKIDVSGGLPAFTLFPGGLNIPQNAIPLTIDASGVLDPITIFPGGFTIDPLPLSLALNISVPDSSVPIIIVPPTPGFGNATATPSSGFFNSGAGGVSGFGNFGAGSSGWWNQAHAALAGAGSGVLNVGTLNSGVLNVGSGISGLYNTAIVGLGTPALVSGAGNVGQQLSGVLAAGTALTQSPIINLGLADVGNYNLGLGNVGDFNLGAANLGDLNLGLGNIGNANVGFGNIGHGNVGFGNSGLGAALGIGNIGLGNAGSTNVGLANMGVGNIGFANTGTNNLGIGLTGDNQTGIGGLNSGAGNIGLFNSGTGNIGFFNSGTGNWGLFNSGSFNTGIGNSGTGSTGLFNAGGFTTGLANAGSYNTGSFNVGDTNTGGFNPGSINTGWFNTGNANTGIANSGNVDTGALMSGNFSNGILWRGNYEGLFSYSYSLDVPRITILDAHFTGAFGPVVVPPIPVLAINAHLTGNAAMGAFTIPQIDIPALNPNVTGSVGFGPIAVPSVTIPALTAARAVLDMAASVGATSEIEPFIVWTSSGAIGPTWYSVGRIYNAGDLFVGGNIISGIPTLSTTGPVHAVFNAASQAFNTPALNIHQIPLGFQVPGSIDAITLFPGGLTFPANSLLNLDVFVGTPGATIPAITFPEIPANADGELYVIAGDIPLINIPPTPGIGNTTTVPSSGFFNTGAGGGSGFGNFGANMSGWWNQAHTALAGAGSGIANVGTLHSGVLNLGSGLSGIYNTSTLPLGTPALVSGLGNVGDHLSGLLASNVGQNPITIVNIGLANVGNGNVGLGNIGNLNLGAANIGDVNLGFGNIGDVNLGFGNIGGGNVGFGNIGDANFGFGNSGLAAGLAGMGNIGLGNAGSGNVGWANMGLGNIGFGNTGTNNLGIGLTGDNQSGIGGLNSGTGNIGLFNSGTGNIGFFNSGTANFGLFNSGSYNTGIGNSGVASTGLVNAGGFNTGVANAGSYNTGSFNAGDTNTGGFNPGSTNTGWFNTGNANTGVANAGNVNTGALITGNFSNGILWRGNYEGLAGFSFGYPIPLFPAVGADVTGDIGPATIIPPIHIPSIPLGFAAIGHIGPISIPNIAIPSIHLGIDPTFDVGPITVDPITLTIPGLSLDAAVSEIRMTSGSSSGFKVRPSFSFFAVGPDGMPGGEVSILQPFTVAPINLNPTTLHFPGFTIPTGPIHIGLPLSLTIPGFTIPGGTLIPQLPLGLGLSGGTPPFDLPTVVIDRIPVELHASTTIGPVSLPIFGFGGAPGFGNDTTAPSSGFFNTGGGGGSGFSNSGSGMSGVLNAISDPLLGSASGFANFGTQLSGILNRGAGISGVYNTGTLGLVTSAFVSGFMNVGQQLSGLLFAGTGP

SEQ ID NO: 143 - protein, 2523 aa, Mycobacterium tuberculosis H37Rv
MSFVVMPPEINSLLIYTGAGPGPLLAAAAAWDELAAELGSAAAAFGSVTSGLVGGIWQGPSSVAMAAAAAPYAGWLSAAAASAESAAGQARAVVGVFEAALAETVDPFVIAANRSRLVSLALSNLFGQNTPAIAAAEFDYELMWAQDVAAMLGYHTGASAAAEALAPFGSPLASLAAAAEPAKSLAVNLGLANVGLFNAGSGNVGSYNVGAGNVGSYNVGGGNIGGNNVGLGNVGWGNFGLGNSGLTPGLMGLGNIGFGNAGSYNFGLANMGVGNIGFANTGSGNFGIGLTGDNLTGFGGFNTGSGNVGLFNSGTGNVGFFNSGTGNWGVFNSGSYNTGIGNSGIASTGLFNAGGFNTGVVNAGSYNTGSFNAGEANTGGFNPGSVNTGWLNTGDINTGVANSGDVNTGAFISGNYSNGVLWRGDYQGLLGFSSGANVLPVIPLSLDINGGVGAITIEPIHILPDIPININETLYLGPLVVPPINVPAISLGVGIPNISIGPIKINPITLWPAQNFNQTITLAWPVSSITIPQIQQVALSPSPIPTTLIGPIHINTGFSIPVTFSYSTPALTLFPVGLSIPTGGPLTLTLGVTAGTEAFTIPGFSIPEQPLPLAINVIGHINALSTPAITIDNIPLNLHAIGGVGPVDIVGGNVPASPGFGNSTTAPSSGFFNTGAGGVSGFGNVGAHTSGWFNQSTQAMQVLPGTVSGYFNSGTLMSGIGNVGTQLSGMLSGGALGGNNFGLGNIGFDNVGFGNAGSSNFGLANMGIGNIGLANTGNGNIGIGLSGDNLTGFGGFNSGSENVGLFNSGTGNVGFFNSGTGNLGVFNSGSHNTGFFLTGNNINVLAPFTPGTLFTISEIPIDLQVIGGIGPIHVQPIDIPAFDIQITGGFIGIREFTLPEITIPAIPIHVTGTVGLEGFHVNPAFVLFGQTAMAEITADPVVLPDPFITIDHYGPPLGPPGAKFPSGSFYLSISDLQINGPIIGSYGGPGTIPGPFGATFNLSTSSLALFPAGLTVPDQTPVTVNLTGGLDSITLFPGGLAFPENPVVSLTNFSVGTGGFTVFPQGFTVDRIPVDLHTTLSIGPFPFRWDYIPPTPANGPIPAVPGGFGLTSGLFPFHFTLNGGIGPISIPTTTVVDALNPLLTVTGNLEVGPFTVPDIPIPAINFGLDGNVNVSFNAPATTLLSGLGITGSIDISGIQITNIQTQPAQLFMSVGQTLFLFDFRDGIELNPIVIPGSSIPITMAGLSIPLPTVSESIPLNFSFGSPASTVKSMILHEILPIDVSINLEDAVFIPATVLPAIPLNVDVTIPVGPINIPIITEPGSGNSTTTTSDPFSGLAVPGLGVGLLGLFDGSIANNLISGFNSAVGIVGPNVGLSNLGGGNVGLGNVGDFNLGAGNVGGFNVGGGNIGGNNVGLGNVGFGNVGLANSGLTPGLMGLGNIGFGNAGSYNFGLANMGVGNIGFANTGSGNFGIGLTGDNLTGFGGFNTGSGNVGLFNSGTGNVGFFNSGTGNWGVFNSGSYNTGIGNSGIASTGLFNAGGFNTGVVNAGSYNTGSFNAGQANTGGFNPGSVNTGWLNTGDINTGVANSGDVNTGAFISGNYSNGAFWRGDYQGLLGFSYRPAVLPQTPFLDLTLTGGLGSVVIPAIDIPAIRPEFSANVAIDSFTVPSIPIPQIDLAATTVSVGLGPITVPHLDIPRVPVTLNYLFGSQPGGPLKIGPITGLFNTPIGLTPLALSQIVIGASSSQGTITAFLANLPFSTPVVTIDEIPLLASITGHSEPVDIFPGGLTIPAMNPLSINLSGGTGAVTIPAITIGEIPFDLVAHSTLGPVHILIDLPAVPGFGNTTGAPSSGFFNSGAGGVSGFGNVGAMVSGGWNQAPSALLGGGSGVFNAGTLHSGVLNFGSGMSGLFNTSVLGLGAPALVSGLGSVGQQLSGLLASGTALHQGLVLNFGLADVGLGNVGLGNVGDFNLGAGNVGGFNVGGGNIGGNNVGLGNVGWGNFGLGNSGLTPGLMGLGNIGFGNAGSYNFGLANMGVGNIGFANTGSGNFGIGLTGDNLTGFGGFNTGSGNVGLFNSGTGNVGFFNSGTGNWGVFNSGSYNTGIGNSGIASTGLFNAGGFNTGVVNAGSYNTGSFNAGQANTGGFNPGSVNTGWLNTGDINTGVANSGDVNTGAFISGNYSNGAFWRGDYQGLLGFSYTSTIIPEFTVANIHASGGAGPIIVPSIQFPAIPLDLSATGHIGGFTIPPVSISPITVRIDPVFDLGPITVQDITIPALGLDPATGVTVGPIFSSGSIIDPFSLTLLGFINVNVPAIQTAPSEILPFTVLLSSLGVTHLTPEITIPGFHIPVDPIHVELPLSVTIGPFVSPEITIPQLPLGLALSGATPAFAFPLEITIDRIPVVLDVNALLGPINAGLVIPPVPGFGNTTAVPSSGFFNIGGGGGLSGFHNLGAGMSGVLNAISDPLLGSASGFANFGTQLSGILNRGADISGVYNTGALGLITSALVSGFGNVGQQLAGLIYTGTGP

SEQ ID NO: 144 - protein, 778 aa, Mycobacterium tuberculosis H37Rv
MSFVIAVPEALTMAASDLANIGSTINAANAAAALPTTGVVAAAADEVSAAVAALFGSYAQSYQAFGAQLSAFHAQFVQSLTNGARSYVVAEATSAAPLQDLLGVVNAPAQALLGRPLIGNGANGADGTGAPGGPGGLLLGNGGNGGSGAPGQPGGAGGDAGLIGNGGTGGKGGDGLVGSGAAGGVGGRGGWLLGNGGTGGAGGAAGATLVGGTGGVGGATGLIGSGGFGGAGGAAAGVGTTGGVGGSGGVGGVFGNGGFGGAGGLGAAGGVGGAASYFGTGGGGGVGGDGAPGGDGGAGPLLIGNGGVGGLGGAGAAGGNGGAGGMLLGDGGAGGQGGPAVAGVLGGMPGAGGNGGNANWFGSGGAGGQGGTGLAGTNGVNPGSIANPNTGANGTDNSGNGNQTGGNGGPGPAGGVGEAGGVGGQGGLGESLDGNDGTGGKGGAGGTAGTDGGAGGAGGAGGIGETDGSAGGVATGGEGGDGATGGVDGGVGGAGGKGGQGHNTGVGDAFGGDGGIGGDGNGALGAAGGNGGTGGAGGNGGRGGMLIGNGGAGGAGGTGGTGGGGAAGFAGGVGGAGGEGLTDGAGTAEGGTGGLGGLGGVGGTGGMGGSGGVGGNGGAAGSLIGLGGGGGAGGVGGTGGIGGIGGAGGNGGAGGAGTTTGGGATIGGGGGTGGVGGAGGTGGTGGAGGTTGGSGGAGGLIGWAGAAGGTGAGGTGGQGGLGGQGGNGGNGGTGATGGQGGDFALGGNGGAGGAGGSPGGSSGIQGNMGPPGTQGADG

SEQ ID NO: 145 - protein, 1079 aa, Mycobacterium tuberculosis H37Rv
PQGADGNAGNGGDGGVGGNGGNGADNTTTAAAGTTGGAGGAGGAGGTGGTGGAAGTGTGGQQGNGGNGGNGGTGGKGGTGGDGALAGSSGGAGGKGGNGGDAGKAGTGSAPGTAGTGGDGGKGGNGGIGAAGTTGPVGTGASGGTGGSGGAGGTGGDGGAANGGTAGAGGAGGNGGKGGDGGAGVTSSTAGNSGGAGGSGGKGGDAGAGGAGATPGANGIAGNGGDGGDGAAGAVGISGATGAGDGGHGGTGAAGGNGGTGGAGGSGIDGVGGGTGGTGGNGGNGAIGGAGGDAGGSGNSGGNGGIGGKGGNAGAGGAAGSNGGTVGANGTGGDGGNGGAAGAATAGSNGGAGTGSAGGNGGTGGRGGSGGAGGDGIGGVGGGKGGNGADGEVGGAGGAGGSGPNTSPGGNGGQGGQGGSGGAGGAAGAGGAGGGANGTAGNGGQGGAGGTGGAGAASSATNGGSGGAGGTGGDGGSGGAGGTGGAGGTGGAAGDGGQGGQGGAGGGAGGQGGAGGAGGTGGNGGNITGGTAGTAGAAGNGGAAGKGGAGGQGGTGGGTGGQGGAGGDGGAGGTGGDRTVGGGTVPAGSGGQGGNAGGGGAGGQGGADGGSGGDGGDAGTGGNGGNGGNRNSGNGTGGAGGNGGGGANGGAGGAGGSGGGTGGNGGAGGDAGDAGNGGNGNGTGNGGNGGNGGIAGMGGNGGAGTGSGNGGNGGSGGNGGNAGMGGNSGTGSGDGGAGGNGGAAGTGGTGGDGGLTGTGGTGGSGGTGGDGGNGGNGADNTANMTAQAGGDGGNGGDGGFGGGAGAGGGGLTAGANGTGGQGGAGGDGGNGAIGGHGPLTDDPGGNGGTGGNGGTGGTGGAGIGSLGGGTGGDGGNGGNGGTGGEGGEVGGAGGTGGAAGNGGDGGTGGTGGGDGGAGGTGGTGGTGGLGDPRVGGSGGDGGTGGSGGAAGNGGNGGNAGAGGNGNGGTGGAGGIGGTGGNGGDAEPGVPPGAGGAGGAGTTGGKGGTGGNGSGTGSGGTGGDGGTGGGGGNGGTGWNGGKGDTGSGGGAGDGGKAPAGGTGGAGGDGGAGGKGGSGGV

SEQ ID NO: 146 - protein, 1538 aa, Mycobacterium tuberculosis H37Rv
MVMSLMVAPELVAAAAADLTGIGQAISAANAAAAGPTTQVLAAAGDEVSAAIAALFGTHAQEYQALSARVATFHEQFVRSLTAAGSAYATAEAANASPLQALEQQVLGAINAPTQLWLGRPLIGDGVHGAPGTGQPGGAGGLLWGNGGNGGSGAAGQVGGPGGAAGLFGNGGSGGSGGAGAAGGVGGSGGWLNGNGGAGGAGGTGANGGAGGNAWLFGAGGSGGAGTNGGVGGSGGFVYGNGGAGGIGGIGGIGGNGGDAGLFGNGGAGGAGAAGLPGAAGLNGGDGSDGGNGGTGGNGGRGGLLVGNGGAGGAGGVGGDGGKGGAGDPSFAVNNGAGGNGGHGGNPGVGGAGGAGGLLAGAHGAAGATPTSGGNGGDGGIGATANSPLQAGGAGGNGGHGGLVGNGGTGGAGGAGHAGSTGATGTALQPTGGNGTNGGAGGHGGNGGNGGAQHGDGGVGGKGGAGGSGGAGGNGFDAATLGSPGADGGMGGNGGKGGDGGKAGDGGAGAAGDVTLAVNQGAGGDGGNGGEVGVGGKGGAGGVSANPALNGSAGANGTAPTSGGNGGNGGAGATPTVAGENGGAGGNGGHGGSVGNGGAGGAGGNGVAGTGLALNGGNGGNGGIGGNGGSAAGTGGDGGKGGNGGAGANGQDFSASANGANGGQGGNGGNGGIGGKGGDAFATFAKAGNGGAGGNGGNVGVAGQGGAGGKGAIPAMKGATGADGTAPTSGGDGGNGGNGASPTVAGGNGGDGGKGGSGGNVGNGGNGGAGGNGAAGQAGTPGPTSGDSGTSGTDGGAGGNGGAGGAGGTLAGHGGNGGKGGNGGQGGIGGAGERGADGAGPNANGANGENGGSGGNGGDGGAGGNGGAGGKAQAAGYTDGATGTGGDGGNGGDGGKAGDGGAGENGLNSGAMLPGGGTVGNPGTGGNGGNGGNAGVGGTGGKAGTGSLTGLDGTDGITPNGGNGGNGGNGGKGGTAGNGSGAAGGNGGNGGSGLNGGDAGNGGNGGGALNQAGFFGTGGKGGNGGNGGAGMINGGLGGFGGAGGGGAVDVAATTGGAGGNGGAGGFASTGLGGPGGAGGPGGAGDFASGVGGVGGAGGDGGAGGVGGFGGQGGIGGEGRTGGNGGSGGDGGGGISLGGNGGLGGNGGVSETGFGGAGGNGGYGGPGGPEGNGGLGGNGGAGGNGGVSTTGGDGGAGGKGGNGGDGGNVGLGGDAGSGGAGGNGGIGTDAGGAGGAGGAGGNGGSSKSTTTGNAGSGGAGGNGGTGLNGAGGAGGAGGNAGVAGVSFGNAVGGDGGNGGNGGHGGDGTTGGAGGKGGNGSSGAASGSGVVNVTAGHGGNGGNGGNGGNGSAGAGGQGGAGGSAGNGGHGGGATGGDGGNGGNGGNSGNSTGVAGLAGGAAGAGGNGGGTSSAAGHGGSGGSGGSGTTGGAGAAGGNGGAGAGGGSLSTGQSGGPRRQRWCRWQRRRWLGRQRRRRWCRWQRRCRRQRWRWRCRQRRLRRQWRQGRRRCRPWLHRRRGRQGRRWRQRRFQQRQRSRWQRR

SEQ ID NO: 147 - protein, 923 aa, Mycobacterium tuberculosis H37Rv
MSFVVTAPPVLASAASDLGGIASMISEANAMAAVRTTALAPAAADEVSAAIAALFSSYARDYQTLSVQVTAFHVQFAQTLTNAGQLYAVVDVGNGVLLKTEQQVLGVINAPTQTLVGRPLIGDGTHGAPGTGQNGGAGGILWGNGGNGGSGAPGQPGGRGGDAGLFGHGGHGGVGGPGIAGAAGTAGLPGGNGANGGSGGIGGAGGAGGNGGLLFGNGGAGGQGGSGGLGGSGGTGGAGMAAGPAGGTGGIGGIGGIGGAGGVGGHGSALFGHGGINGDGGTGGMGGQGGAGGNGWAAEGITVGIGEQGGQGGDGGAGGAGGIGGSAGGIGGSQGAGGHGGDGGQGGAGGSGGVGGGGAGAGGDGGAGGIGGTGGNGSIGGAAGNGGNGGRGGAGGMATAGSDGGNGGGGGNGGVGVGSAGGAGGTGGDGGAAGAGGAPGHGYFQQPAPQGLPIGTGGTGGEGGAGGAGGDGGQGDIGFDGGRGGDGGPGGGGGAGGDGSGTFNAQANNGGDGGAGGVGGAGGTGGTGGVGADGGRGGDSGRGGDGGNAGHGGAAQFSGRGAYGGEGGSGGAGGNAGGAGTGGTAGSGGAGGFGGNGADGGNGGNGGNGGFGGINGTFGTNGAGGTGGLGTLLGGHNGNIGLNGATGGIGSTTLTNATVPLQLVNTTEPVVFISLNGGQMVPVLLDTGSTGLVMDSQFLTQNFGPVIGTGTAGYAGGLTYNYNTYSTTVDFGNGLLTLPTSVNVVTSSSPGTLGNFLSRSGAVGVLGIGPNNGFPGTSSIVTAMPGLLNNGVLIDESAGILQFGPNTLTGGITISGAPISTVAVQIDNGPLQQAPVMFDSGGINGTIPSALASLPSGGFVPAGTTISVYTSDGQTLLYSYTTTATNTPFVTSGGVMNTGHVPFAQQPIYVSYSPTAIGTTTFN

SEQ ID NO: 148 - protein, 749 aa, Mycobacterium tuberculosis H37Rv
MIGNGGAGGSGAPGAIGGAGGPAGLIGVGGAGGAGGDSAVAGVIGGAGGAGGAALLFGAGGAGGAGGSGGSGAAGGAGGAGGAGGLFASGGSGGFGGFASTGTGGAGGTGGAGGLFASGGVGGTGGGAGSGGTGGVGGTGGAGGLFASGGAGGAGGSGGTGGAGGTGGAGGLFGAGGAGGLGGQGNHTGGHGGAGGSAGLLALGDGGAGGAGGAATTGTGGAGGAGGKAGLLFGSGGAGGSGGAAGTFGDTGNSGGAGGAGGKAGLLFGSGGAGGSGGAGGFANGSTGGAGGAGGGAGLIGNGGNGGSGGTSVATGGAGNGGAGGAGGGAGLIGNGGNGGSGGMGDAPGGTGVGGIGGLLLGLDGANAPASTNPLHTAQQQALAAVNAPIQAVTGRPLIGNGANGAPGSGAPGGHGGWLFGGGGTGGSGVSGGAGGDGGAGGILFGAGGAGGAGGAVTGTGATGGSGGAGGGALLFGAGGAGGAGGSSGIGGFAAGGAGGPGGAGGLFNGGGAGGAGGSGVSGGAGGEGGAGGAGGLFAGGGAGGAGGSGNNVGGAGGAGGVGGLFGAGGAGGSGGGGSVAGDSGAGGNAGLLAPGLAGGAGGGGGQGFDTGGAGGPGGDAGLLVGSGGVGGAGGFGLTTGGPGAAGGDAGLLFGSGGAGGAGGSGRTDLGGAGGAGGKAGLIGNGGNGGAGGAGGNGGGDGGPGGAAFGLGNGGNGGNGGTGTSAGSPGAGGAGGSLIGAEGLPGLLP

SEQ ID NO: 149 - protein, 853 aa, Mycobacterium tuberculosis H37Rv
MSFVIAAPEALVAVASDLAGIGSALAEANAAALAPTTALLAAGADEVSAAIAALFGAHGQAYQTVSAQASAFHAQFVQALTGGGGAYAAAEAANVSAAQSTDQRLLDLINGPTQALLGRPLIGDGANGGPGQDGGPGGLLYGNGGNGGTSTTAGVAGGNGGAAGLIGNGGAGGGGGAGAAGGNGGAGGWLYGNGGAGGAGGTSVIPGVAGGNGGAGGSAGLWGTGGAGGDGGNGRSGPVNVAGSAGGNGGAGGAAGLFGDAGAGGNGGKGGAGGAAFSINFTAGDGGAGGAGGSGGHALLWGAGGAGGNGGSGGTGGAGGSTAGAGGNGGAGGGGGTGGLLFGNGGAGGHGAAAGNGLAAGNGVSSSGGGGAGGTGGAGGDGGAGGAGGNARLWGVGGAGGAGGDGGAGGAGGKGGSGLSGNANGGAGGDSGRGGTGGAGGEGGAAGLLVGTGGHGGDGGAGGAAVKGGDGGAAAGTGIAGAGGRGGAGGSGGSGGDGGGGAAGPAGWLFGDGGAGGNGGAAAAGGAGGQAGGGGGNGGNGGNGGNGGNGGNGATGGWLYGNGGAGGQGATAGAGGAGANGVSSTNGGGTGGNGGIGGTGGSGGAGGNAGLLGVGGAGGHGASGGAGDRGGAGGTGFISSDGGAGGDGGDGGNGGAGGTGGLLFGAGGNGGPGGSGGAADIGGNGGAGNGGGTDGNGGNGGSGGGAGSGGDGGGAGGNGAWLFGNGGAGGGGGKGGNGAGGGLGGGSFGLPGLNGSGGDGGDGGNGAPGGVLYGNGGAGGQGSSGGIGGPGATGGAGGKGGDGGDAQLIGDGGNGGNGGAGGTGGTPGPGGPGGSGGLGGLLFGQTGTAGVSP

SEQ ID NO: 150 - protein, 618 aa, Mycobacterium tuberculosis H37Rv
MSYLVVVPELVAAAATDLANIGSSISAANAAAAAPTTALVAAGGDEVSAAIAALFGAHARAYQALSAQAAMFHEQFVRALAAGGNSYAVAEAATAQSVQQDLLNLINAPTQALLGRPLIGNGANGLPGTGQNGGDGGILYGNGGNGGSGGVNQAGGNGGNAGLWGNGGSGGAGGNATTAGRNGFNGGAGGSGGLLWGNGGAGGAGGNGGPAPLVGGVGTTGGAGGNGGGAGLFYGFGGAGGNGGMGGVAPSTGPSMGILPAGGVGGPGGSGGASALAFGSGGVGGAGGLGGPTDGTVQGVGGFGGQGGNGGQSGLLFGNAGAGGAGAAGGAGTGDTESFGGHGGAGGDGGAVGLIGNGGAGGTGSPGAVVGGNGGVGGLGGAGSPGGLLYGTGGAGGNGGPGGDGGTGATVGFAGSGGFGGAGGIAQLFGTGGMGGSGGGIGAGTTTVVPPDVAPVGGTGGNGGRAGLLLGVGGMGGNGGATSVGGTLYAAGGNGGDGGLVWGNGGTGGSGGAGGAGSVGNGGAGGNAALLFGNGGAGGAGGAGGIGAGGAGGFGAVLFGNGGAGGSGAPGGIGAGGNGGNALLVGNGGNGGAGTGGAAGGAGGSGGLLFGQNGMPGP

SEQ ID NO: 151 - protein, 1053 aa, Mycobacterium tuberculosis H37Rv
MNFSVLPPEINSALIFAGAGPEPMAAAATAWDGLAMELASAAASFGSVTSGLVGGAWQGASSSAMAAAAAPYAAWLAAAAVQAEQTAAQAAAMIAEFEAVKTAVVQPMLVAANRADLVSLVMSNLFGQNAPAIAAIEATYEQMWAADVSAMSAYHAGASAIASALSPFSKPLQNLAGLPAWLASGAPAAAMTAAAGIPALAGGPTAINLGIANVGGGNVGNANNGLANIGNANLGNYNFGSGNFGNSNIGSASLGNNNIGFGNLGSNNVGVGNLGNLNTGFANTGLGNFGFGNTGNNNIGIGLTGNNQIGIGGLNSGTGNFGLFNSGSGNVGFFNSGNGNFGIGNSGNFNTGGWNSGHGNTGFFNAGSFNTGMLDVGNANTGSLNTGSYNMGDFNPGSSNTGTFNTGNANTGFLNAGNINTGVFNIGHMNNGLFNTGDMNNGVFYRGVGQGSLQFSITTPDLTLPPLQIPGISVPAFSLPAITLPSLNIPAATTPANITVGAFSLPGLTLPSLNIPAATTPANITVGAFSLPGLTLPSLNIPAATTPANITVGAFSLPGLTLPSLNIPAATTPANITVGAFSLPGLTLPSLNIPAATTPANITVGAFSLPGLTLPSLNIPAATTPANITVSGFQLPPLSIPSVAIPPVTVPPITVGAFNLPPLQIPEVTIPQLTIPAGITIGGFSLPAIHTQPITVGQIGVGQFGLPSIGWDVFLSTPRITVPAFGIPFTLQFQTNVPALQPPGGGLSTFTNGALIFGEFDLPQLVVHPYTLTGPIVIGSFFLPAFNIPGIDVPAINVDGFTLPQITTPAITTPEFAIPPIGVGGFTLPQITTQEIITPELTINSIGVGGFTLPQITTPPITTPPLTIDPINLTGFTLPQITTPPITTPPLTIDPINLTGFTLPQITTPPITTPPLTIEPIGVGGFTTPPLTVPGIHLPSTTIGAFAIPGGPGYFNSSTAPSSGFFNSGAGGNSGFGNNGSGLSGWFNTNPAGLLGGSGYQNFGGLSSGFSNLGSGVSGFANRGILPFSVASVVSGFANIGTNLAGFFQGTTS

SEQ ID NO: 152 - protein, 615 aa, Mycobacterium tuberculosis H37Rv
MLYVVASPDLMTAAATNLAEIGSAISTANGAAALPTVEVVAAAADEVSTQIAALFGAHARSYQTLSTQAAAFHSRFVQALTTAAASYASVEAANASPLQVALDVINAPAQTLLGRPLIGNGADGSTPGQAGGPGGLLYGNGGNGAAGGPNQAGGAGGNAGLIGNGGAGGAGGVGAVGGKRGTGGLLFGNGGAGGQGGLGLAGINGGSGGQGGHGGNAILFGQGGAGGPGGTGAMGVAGTNPTPIGTAAPGSDGVNQIGNGGNTDLTGGAGGDGNAGSTTVNGGNGGTGGAARNSSGGTGNSFGGAGGAGGDGANGGDGGAGGEALTEGGATAVSGAGGKGGNAEASGGAGGNGGKGGFAQATTSVTGGNGGNGGNGHDSNAPGGAGGSGGVGGDGGRGGLLAGNGGTGGAGGNGGTGGAGAPGGAGGAGGKADIANSLGDNATVTGGNGGTGGDGGSALGTGGAGGAGGLGGHGGAGGLLIGNGGAGGAGGLGGAGGAGGAGGEGGAGGAGGEAIPGGASTNSAGGDGGAGGTGGNGGDGGAGGAPGLGGAGGAGGWLIGQSGSTGGGGAGGAGGAGGAGGAGGSGGAGGHGDTTSGKNGSSGTAGFDGNPGQPG

SEQ ID NO: 153 - protein, 987 aa, Mycobacterium tuberculosis H37Rv
MHYSVLPPEINSALIFAGAGSGPMLAAASAWDGLATELASAAVSFGSVTAGLVGGSWQGRSSVAMAAAAAPYAGWLAAAATQAEQAATQAQVMVAEFEAVRLAMVQPALVAANRSGLISLVISNLFGQNAPAIAAAEAAYEEMWALDVSAMAAYHSGASAVAVALPAFALPLRLPAGLAAGPAAVVTALTTAVGMPTFAGRAIAASLGLANVGGGNLGNANNGLGNIGNANLGNNNLGSGNFGSFNIGSANLGGNNIGIGNAGANNFGLANLGNLNTGFANAGIGNFGIANTGNNNIGNGLTGNNQIGIGGLNSGNGNVGLFNAGSANIGFFNSGNGNFGIGNSGNFSTGLFNPGHGNTGFLNAGSFNTGMFDVGNANTGSFNVGHYNFGAFNPGPSNTGTFNTGGANTGWFNTGSINTGAFNIGDMNNGLFNTGDMNNGVFYRGVGQGSLQFAITSPDLTLPSLEIPGISVPAFSLPAITLPSLTIPAVTTPANVTVGAFDLPGLTVPSLTIPAAMTPANITVGAFDLPGLTVPSLTIPATTTPANITVGAFNLPQLSIPSVTVPPITIPAGTALGAFNLPTLSIPSVTVPPITIPAGTTVGGFTLPTIHTPLISTPQISIGGFSTPGIATQANSGVINLPTFSLNGITITNLVVFIPNNITALQTNMPGVFPQIGGFANTPPAFINTGTITVGGGQINGVGFSIGAINVTPFTLPNVVIQPWSLGGISVDGFTLPEISTQEFTTPALTISPIGVGALSLPDITTQQFTTPELTIDPITLGGFTLPQLSIPAITTPAFTIDPIALGGFTLPQIMTPEITTPPFAIDPIGLSGFTLPQVNIPEITTPEFTIQPVGLAAFTTPALTIASIHLPSTTMGGFAIPAGPGYFNSSATPSLGFFNAGIGGNSGFGNSGSGLSGWFNTSPVGLLAGSGYQNYGGLISGFSNLGSGISGFANTGTLPFAVTSLVSGLANIGNNLSGLFFQSTTP

SEQ ID NO: 154 - protein, 767 aa, Mycobacterium tuberculosis H37Rv
MSFVVVAPEVLAAAASDLAGIGSTLAQANAAALAPTTAVLAAGADEVSAAIASLFGAHGQAYQAVSAQMSAFHAQFMQALTGAGGAYAAAEAVNVSAAQSVEQDLLAAINARFERIFGRPLIGDGANGGPGQDGGPGGLLYGNGGNGGTSTTVGMAGGNGGAAGLIGNGGFGGGGGPGAAGGNGGAGGWLFGNGGAGGAGGLGVAPGVPGGAGGAGGAGGVGGPAGLWGHGGAGGAGGAGVAGAGGFEGTIGAGGAGGVGGAGGVGGAGGAGGWLYGDAGAGGDGGVGGAGGTGGLGNRGGAGGAGGAGGVGGAGGAAGLWGGGGAGGVGGTGGGAGLGAQSVTFSSSLSGLSGGDGGAGGAGGAGGAGGTGGWLYGGGGAAGSGGDGGTGGQGGAGGAGVFSLFGSGGGPGGNGGVGGVGGVGGAGGRAGLFGVGGLGGAGGDAGDSGEGGFGGPGLAGGLFGNPGNGGVGGIGGDAAAGGAGGAGGNGGAGGNGGWLFGNGGAGGSGGDGGAAGRGGAGNLGSAGGINAPAGNPGSGSVGIGGAGGAGGTAGLFGDGGAGGAGGAGAAGGFGGISAATPSAGSEGAMGGAGGVGGNARLLGTGGAGGVGGGGGAGGDGGRGGVATPGGQGGDAGDGGAGGAGGNGGGASGAGGWLLGTGGAGGAGGNGGNGGKAGFSPGPTNFGLNGAGGGGGVGGNGATGPWLFGDGGPTPGSTGAGAAGGHGGDAQLIGNGGHGGAGGTGVPNGSGGAGGLSGLLFGEPGANG

SEQ ID NO: 155 - protein, 731 aa, Mycobacterium tuberculosis H37Rv
MSFVIANPEMLAAAATDLAGIRSAISAATAAAAAPTIQVAAAGADEVSLAISALFGQHAQAYQALSAQATIFHDQFVQALTSGGNLYAAAESHTVEQMVLNAINAPTQTLFGRPLIGDGANGTAENPDGQNGGLLFGNGGNGFTQTTAGVAGGNGGSAGLIGNGGAGGGGGAGAAGGLGGNGGWLYGNGGAGGIGGAGTGTGGHGGAGGAGGRAWLWGTGGAGGAGGDGGWLFGDGGAGGTGGNGGSGFNSLTSSVGGAGGAGGHAGLFGAGGTGGTGGIGGQNTETGPAASNGGAGGAGGGGGYLVGDGGAGGTGGAGGKNSSGGATLTGGTGGTGGAGGAAGWLYGSGGAGGAGGAGGLNNAGGATGGTGGTGGAGGSGAWLYGNGGAAGAGGNGGNNTSAGTGGVGASGGTGGNAGLIGAGGHGGAGGAGGNQTGGVGNGGAGGNGGAGGAGGQLYGNGGDGGNGGAGGANIAGGNGSDGGAAGHGGAGGSARLIGAGGHGGDGGAGGNTAGRRADAIAGTGGDGGNGGNGGLLSGNAGAGGHGGAGGSSTATTTTGTPPTGATGGNGGNGGAGGTAGFTGSGGIGGNGGAGGTGGNAGVALSVGSTGGLGGNGGSGGLGGGGGSLFGNGGAGGVGATGGNGGSGIGPASVGGNGGKGGVGAAGGLAGQIGNGGSGGSGGAGGNGGTGDTAGNGGNGGAGAVGGNAQLIGNGGNGGGGGNGGTGADGT

SEQ ID NO: 156 - protein, 354 aa, Mycobacterium tuberculosis H37Rv
MPGRFRNFGSQNLGSGNIGSTNVGSGNIGSTNVGSGNIGDTNFGNGNNGNFNFGSGNTGSNNIGFGNTGSGNFGFGNTGNNNIGIGLTGDGQIGIGGLNSGSGNIGFGNSGTGNVGLFNSGTGNVGFGNSGTANTGFGNAGNVNTGFWNGGSTNTGLANAGAGNTGFFDAGNYNFGSLNAGNINSSFGNSGDGNSGFLNAGDVNSGVGNAGDVNTGLGNSGNINTGGFNPGTLNTGFFSAMTQAGPNSGFFNAGTGNSGFGHNDPAGSGNSGIQNSGFGNSGYVNTSTTSMFGGNSGVLNTGYGNSGFYNAAVNNTGIFVTGVMSSGFFNFGTGNSGLLVSGNGLSGFFKNLFG

SEQ ID NO: 157 - protein, 783 aa, Mycobacterium tuberculosis H37Rv
MSFVLAMPEVLGSAATDLAALGSVLGAADAAAAATTTGIVAAAQDEVSAAIAALFSAHGRAYQVASAQAAAVHAQFVEALSAGAGAYASAEAAGAAVLANPAQSVQQDLLAAVNAQSVALTGRPLIGNGANGAPGTGANGAPGGWLLGNGGAGGSAAAGSGLPGGAGGAAGLFGTGGAGGAGGSSTVGDGEAGGAGGSGGWLLGTGGVGGVGGLGAGAGGAGGVGGAGGLLGAGGHGGAGGLGAVTGGVGGTGGAGGLLAGLLAGPGGAGGTGGRGFLNNGGVGGAGGNAGLLFGAGGTGGSGGAGLGGDGGAGGAGGNTGVLFGNAGSGGTGGFGDTDGGAGGAGGDAGWLGSGGVGGAGGFGETGDGGVGGAGGKAGLLIGNGGAGGAGGQGAVTGGTGGAGGDGVLIGNGGNAGIGGTGPTAGDTGAGGISGLLLGADGFNTPASASPLHTLKQQALAAINAPTQTLTGRPLIGNGTPGAVGSGATGAPGGWLLGDGGAGGSGAAGSGAPGGAGGAAGLWGTGGAGGAGGSSAGGGGAGGAGGAGGWLLGDGGAGGIGGASTVLGGTGGGGGVGGLWGAGGAGGAGGTGLVGGDGGAGGAGGTGGLLAGLIGAGGGHGGTGGLSTNGDGGVGGAGGNAGMLAGPGGAGGAGGDGENLDTGGDGGAGGSAGLLFGSGGAGGAGGFGFLGGDGGAGGNAGLLLSSGGAGGFGGFGTAGGVGGAGGNAGWLGFGGAGGVGGSAGLIGTGGNGGNGGTGANAGSPGTGGAGGLLLGQNGLNGLP

SEQ ID NO: 158 - protein, 694 aa, Mycobacterium tuberculosis H37Rv
MSLVIATPQLLATAALDLASIGSQVSAANAAAAMPTTEVVAAAADEVSAAIAGLFGAHARQYQALSVQVAAFHEQFVQALTAAAGRYASTEAAVERSLLGAVNAPTEALLGRPLIGNGADGTAPGQPGAAGGLLFGNGGNGAAGGFGQTGGSGGAAGLIGNGGNGGAGGTGAAGGAGGNGGWLWGNGGNGGVGGTSVAAGIGGAGGNGGNAGLFGHGGAGGTGGAGLAGANGVNPTPGPAASTGDSPADVSGIGDQTGGDGGTGGHGTAGTPTGGTGGDGATATAGSGKATGGAGGDGGTAAAGGGGGNGGDGGVAQGDIASAFGGDGGNGSDGVAAGSGGGSGGAGGGAFVHIATATSTGGSGGFGGNGAASAASGADGGAGGAGGNGGAGGLLFGDGGNGGAGGAGGIGGDGATGGPGGSGGNAGIARFDSPDPEAEPDVVGGKGGDGGKGGSGLGVGGAGGTGGAGGNGGAGGLLFGNGGNGGNAGAGGDGGAGVAGGVGGNGGGGGTATFHEDPVAGVWAVGGVGGDGGSGGSSLGVGGVGGAGGVGGKGGASGMLIGNGGNGGSGGVGGAGGVGGAGGDGGNGGSGGNASTFGDENSIGGAGGTGGNGGNGANGGNGGAGGIAGGAGGSGGFLSGAAGVSGADGIGGAGGAGGAGGAGGSGGEAGAGGLTNGPGSPGVSGTEGMAGAPG

SEQ ID NO: 159 - protein, 837 aa, Mycobacterium tuberculosis H37Rv
MSFVIAAPEVIAAAATDLASLESSIAAANAAAAANTTALLAAGADEVSTAVAALFGAHGQAYQALSAQAQAFHAQFVQALTSGGGAYAAAEAAATSPLLAPINEFFLANTGRPLIGNGTNGAPGTGANGGDGGWLIGNGGAGGSGAAGVNGGAGGNGGAGGLIGNGGAGGAGGRASTGTGGAGGAGGAAGMLFGAAGVGGPGGFAAAFGATGGAGGAGGNGGLFADGGVGGAGGATDAGTGGAGGSGGNGGLFGAGGTGGPGGFGIFGGGAGGDGGSGGLFGAGGTGGSGGTSIINVGGNGGAGGDAGMLSLGAAGGAGGSGGSNPDGGGGAGGIGGDGGTLFGSGGAGGVCGLGFDAGGAGGAGGKAGLLIGAGGAGGAGGGSFAGAGGTGGAGGAPGLVGNAGNGGNGGASANGAGAAGGAGGSGVLIGNGGNGGSGGTGAPAGTAGAGGLGGQLLGRDGFNAPASTPLHTLQQQILNAINEPTQALTGRPLIGNGANGTPGTGADGGAGGWLFGNGGNGGHGATGADGGDGGSGGAGGILSGIGGTGGSGGIGTTGQGGTGGTGGAALLIGSGGTGGSGGFGLDTGGAGGRGGDAGLFLGAAGTGGQAALSQNFIGAGGTAGAGGTGGLFANGGAGGAGGFGANGGTGGNGLLFGAGGTGGAGTLGADGGAGGHGGLFGAGGTGGAGGSSGGTFGGNGGSGGNAGLLALGASGGAGGSGGSALNVGGTGGVGGNGGSGGSLFGFGGAGGTGGSSGIGSSGGTGGDGGTAGVFGNGGDGGAGGFGADTGGNSSSVPNAVLIGNGGNGGNGGKAGGTPGAGGTSGLIIGENGLNGL

SEQ ID NO: 160 - protein, 914 aa, Mycobacterium tuberculosis H37Rv
MSFVIAVPETIAAAATDLADLGSTIAGANAAAAANTTSLLAAGADEISAAIAALFGAHGRAYQAASAEAAAFHGRFVQALTTGGGAYAAAEAAAVTPLLNSINAPVLAATGRPLIGNGANGAPGTGANGGDAGWLIGNGGAGGSGAKGANGGAGGPGGAAGLFGNGGAGGAGGTATANNGIGGAGGAGGSAMLFGAGGAGGAGGAATSLVGGIGGTGGTGGNAGMLAGAAGAGGAGGFSFSTAGGAGGAGGAGGLFTTGGVGGAGGQGHTGGAGGAGGAGGLFGAGGMGGAGGFGDHGTLGTGGAGGDGGGGGLFGAGGDGGAGGSGLTTGGAAGNGGNAGTLSLGAAGGAGGTGGAGGTVFGGGKGGAGGAGGNAGMLFGSGGGGGTGGFGFAAGGQGGVGGSAGMLSGSGGSGGAGGSGGPAGTAAGGAGGAGGAPGLIGNGGNGGNGGESGGTGGVGGAGGNAVLIGNGGEGGIGALAGKSGFGGFGGLLLGADGYNAPESTSPWHNLQQDILSFINEPTEALTGRPLIGNGDSGTPGTGDDGGAGGWLFGNGGNGGAGAAGTNGSAGGAGGAGGILFGTGGAGGAGGVGTAGAGGAGGAGGSAFLIGSGGTGGVGGAATTTGGVGGAGGNAGLLIGAAGLGGCGGGAFTAGVTTGGAGGTGGAAGLFANGGAGGAGGTGSTAGGAGGAGGAGGLYAHGGTGGPGGNGGSTGAGGTGGAGGPGGLYGAGGSGGAGGHGGMAGGGGGVGGNAGSLTLNASGGAGGSGGSSLSGKAGAGGAGGSAGLFYGSGGAGGNGGYSLNGTGGDGGTGGAGQITGLRSGFGGAGGAGGASDTGAGGNGGAGGKAGLYGNGGDGGAGGDGATSGKGGAGGNAVVIGNGGNGGNAGKAGGTAGAGGAGGLVLGRDGQHGLT

SEQ ID NO: 161 - protein, 741 aa, Mycobacterium tuberculosis H37Rv
MSLVIVTPETVAAAASDVARIGSSIGVANSAAAGSTTSVLAAGADEVSAAIATLFGSHAREYQAISTQVAAFHDRFAQTLSAAVGSYVSAEATNAAPLATLEHNVLNALNAPTQALLGRPLIGDGAAGAPGTGQAGGAGGILWGNGGAGGSGAPGQVGGAGGAAGLFGTGGAGGAGGAGAAGGAGGSGGWLLGNGGVGGAGGQSLLGGATGGAGGNAGLFGVGGTGGPGGPGGPGGVGGTGGAGGLGGTLYGAGGHGGAGGPGPIGGVGGHGGVGGAAGLLGVGGHGGAGGHGAEGVAGAAGEDLSPHGTSGGVGGDAGDGGTGGRGGWLAGAGGAGGAGGVGGTGGAGGAGFSRALIVAGDNGGDGGNGGMGGAGGAGGPGGAGGLISLLGGQGAGGAGGTGGAGGVGGDRGAGGPGNQAFNAGAGGAGGHGGDPGAGGAGGTGGAGSITGAQGAIGATPTSGGNGGAGGNGANATTAGTNGANGGPGGHGGLVGNGGAGGNGANGAAGTNASDSGAVGGKGNSGGNGGQGGAGGDGGTLAGNGGAGGTGGRGADGGLGGSGAEGANATTAGERGQDGGKGGNGGVGGTGGNAVAPGANGGHGGNGGNPGFSGAGGLGGLSGDGVTRAAQGATPDFADTGGKGGNGGNGANAVAPGGTGASGGAGGNAGAGGKGGENIIGDGGGGNGGAGGKGGAGTLLGLTVFGDNGGAGVLGDSTDPDGSGGAGGAGGAGGAGGDPTI

SEQ ID NO: 162 - protein, 543 aa, Mycobacterium tuberculosis H37Rv
MSFVTAAPEMLATAAQNVANIGTSLSAANATAAASTTSVLAAGADEVSQAIARLFSDYATHYQSLNAQAAAFHHSFVQTLNAAGGAYSSAEAANASAQALEQNLLAVINAPAQALFGRPLIGNGANGTAASPNGGDGGILYGNGGNGFSQTTAGVAGGAGGSAGLIGNGGNGGAGGAGAAGGAGGAGGWLLGNGGAGGPGGPTDVPAGTGGAGGAGGDAPLIGWGGNGGPGGFAAFGNGGAGGNGGASGSLFGVGGAGGVGGSSEDVGGTGGAGGAGRGLFLGLGGDGGAGGTSNNNGGDGGAGGTAGGRLFSLGGDGGNGGAGTAIGSNAGDGGAGGDSSALIGYAQGGSGGLGGFGESTGGDGGLGGAGAVLIGTGVGGFGGLGGGSNGTGGAGGAGGTGATLIGLGAGGGGGIGGFAVNVGNGVGGLGGQGGQGAALIGLGAGGAGGAGGATVVGLGGNGGDGGDGGGLFSIGVGGDGGNAGNGAMPANGGNGGNAGVIANGSFAPSFVGFGGNGGNGVNGGTGGSGGILFGANGANGPS

SEQ ID NO: 163 - protein, 606 aa, Mycobacterium tuberculosis H37Rv
MSYVLATPEMVAAAANNLAQIGSTLSAANAAALAPTTGVLAAGADEVSAAVASLFSGHAQAYQTLGTQAAAFHERFIQALSTAAGAYGSAEAANASPLQQALNVINAPTQTLLGRPLIGNGTNGAPGTGQAGGPGGLLYGNGGNGGSGGVGQAGGAGGSAGLIGIGGTGGAGGAGAVGGVGGNGGWLYGNGGAGGLGGTGVAGVNGGMGAAGGAGGNAYLFGSGGAGGQGGMGAAGADGVNPTPTGTADAGSTGTDQTLGGNAIGGNGGPGDAGDAMTSGGAGGSGGNAVSTVNGDAVGGEGGKGGEGAYGGAGGAGGSAASIGNAAIGGNGGAGGNAQAPGGVGGAGGEGGDAQVGTNSPSNAEAGNGGSGGNGFDSFASGGTGGAGGTGGAGGRGGLLIGDGGAGGAGGVGGTGGSGAPGGGGGAGGDGGAANTDSAGSSRKAFGGDGGVGGDGASALGTGGEGGIGGQGGNGGAGGLLIGNGGAGGVGGTAGAGGTGGSGGAGGAGGAGGGGTNSGPGAAFGGNGNTGGNGGNGGAPGALGGKGGSGGLIGRAGSDGGVGAGGAGGAGGAGGTGGEGGTGGDGKTTDGNPGMGGSPGSAGQPG

SEQ ID NO: 164 - protein, 576 aa, Mycobacterium tuberculosis H37Rv
MSFLFAQPEMLGAAATDLASIGSAISTANAAAAAATTRVLAAGADEVSAAVAALFSGHAQTYQALRTQAAAFHQQIVQTLTSTAGAYASAEAANVEQQLLGAINAPTMALLGRPLIGHGADGAPGTGQAGGAGGILYGNGGNGGSGATGQAGGAGGAAGLIGHGGAGGLGGTGASGGAGGAGGWLWGNGGAGGNGGVGVAGDPGGVGGAGGAGGAAGLWGSGGSGGTGGQGGVGGGKSGDGGTGGIGGAGGGGGWLHGDGGAGGHGGQGGTGVSSGGNGGAGGTGGDGRGLSGSGGAGGRGGQTGVGGKVGENNFGGAGGAGGTGGLIGNGGAGGNGGQGAISGAGGAGGNAWLIGDGGAGGNGGDIRGQGGGAGGAGGAGGQLIGNGGTGGAGGTVTSPNGLGGAGGAGGSAGLIGHGGTGGAGGHSAQGPDGNGGIGGAGGAGGNGGQLYGTGGTGGTGGKGGDGFGVFGKGGAGGTGGRGGAAGLIGDAGTGGTGGKGGTAGEDGTGGNGGTGGNGGAAVLIGNGGGGGAGGNGGAGNDGTPGNGGGGGVGGTGGTLFGQPGQPGPPGQPGPA

SEQ ID NO: 165 - protein, 639 aa, Mycobacterium tuberculosis H37Rv
MWTSQMIVAPAFVDAAAKDLATIGSAISRANAEALVPITALLPAGADDVSAAIAALFATHGQAYQELSAHAVAFHEQFVQLMSAGAAQYASAEAANSSPLQIVGQTALDAINSPVQTLTGRPLIGNGANGVAGTGQNGGDGGWLYGNGGNGGSGGTGQNGGNGGSAGLWGSGGNGGQGGAGANGAAGQPGKAGGSGGNGGAGGWIYGHGGHGGAGGNGGNATAPGGASAGFDGGAGGNGGSGGRGGLLFGNGGNGSVGGMGGQGTNDTAGDSAGSGGLGGNGGNGAQGGWLIGNGGQGGDSGAGGGTDSTQTGVMNGASGGSAGIAGNGGDAGLVGNGGAGGNGGNGAAGSALGTTIFGGSGGVGGSGGDGGNGGWLFGSGASGGNGGQGGDAGTNGFAGFGGSAGGGGWVGAVNFGPISVQGFGLFGHGGDGGNGGDVGAGSLSIQFGASGGDGGQGGVLYGNGGNGGNAGSGGGTGFEGSAGQGGAAILIGNGGAGGNGATGGTGVGNIIQEAGGDGSDGGAGGSGGLLFGSGGAGGIGGAGGVGGSGNDGGNGGDGGQGGASGLGIGNGGPGGSGGTGGAGGTGGSAGTGGAGGDGGNAALLIGTGGDGGDGVPPAPGGQGGKGGLIGLPGQNGQP

SEQ ID NO: 166 - protein, 801 aa, Mycobacterium tuberculosis H37Rv
MSWVMVSPELVVAAAADLAGIGSAISSANAAAAVNTTGLLTAGADEVSTAIAALFGAQGQAYQAASAQAAAFYAQFVQALSAGGGAYAAAEAAAVSPLLAPINAQFVAATGRPLIGNGANGAPGTGANGGPGGWLIGNGGAGGSGAPGAGAGGNGGAGGLFGSGGAGGASTDVAGGAGGAGGAGGNAGMLFGAAGVGGVGGFSNGGATGGAGGAGGAGGLFGAGRERGSGGSGNLTGGAGGAGGNAGTLATGDGGAGGTGGASRSGGFGGAGGAGGDAGMFFGSGGSGGAGGISKSVGDSAAGGAGGAPGLIGNGGNGGNGGASTGGGDGGPGGAGGTGVLIGNGGNGGSGGTGATLGKAGIGGTGGVLLGLDGFTAPASTSPLHTLQQDVINMVNDPFQTLTGRPLIGNGANGTPGTGADGGAGGWLFGNGGNGGQGTIGGVNGGAGGAGGAGGILFGTGGTGGSGGPGATGLGGIGGAGGAALLFGSGGAGGSGGAGAVGGNGGAGGNAGALLGAAGAGGAGGAGAVGGNGGAGGNGGLFANGGAGGPGGFGSPAGAGGIGGAGGNGGLFGAGGTGGAGGGSTLAGGAGGAGGNGGLFGAGGTGGAGSHSTAAGVSGGAGGAGGDAGLLSLGASGGAGGSGGSSLTAAGVVGGIGGAGGLLFGSGGAGGSGGFSNSGNGGAGGAGGDAGLLVGSGGAGGAGASATGAATGGDGGAGGKSGAFGLGGDGGAGGATGLSGAFHIGGKGGVGGSAVLIGNGGNGGNGGNSGNAGKSGGAPGPSGAGGAGGLLLGENGLNGLM

SEQ ID NO: 167 - protein, 434 aa, Mycobacterium tuberculosis H37Rv
GQSYQAVSAQAAAFHDRFVQLLNAGGGSYASAEIANAQQNLLNAVNAPTQTLLGRPLVGDGADGASGPVGQPGGDGGILWGNGGNGGDSTSPGVAGGAGGSAGLIGNGGRGGNGAPGGAGGNGGLGGLLLGNGGAGGVGGTGDNGVGDLGAGGGGGDGGLGGRAGLIGHGGAGGNGGDGGHGGSGKAGGSGGSGGFGQFGGAGGLLYGNGGAAGSGGNGGDAGTGVSSDGFAGLGGSGGRGGDAGLIGVGGGGGGNGGDPGLGARLFQVGSRGGDGGVGGWLYGDGGGGGDGGNGGLPFIGSTNAGNGGSARLIGNGGAGGSGGSGAPGSVSSGGVGGAGNPGGSGGNGGVWYGNGGAGGAAGQGGPGMNTTSPGGPGGVGGHGGTAILFGDGGAGGAGAAGGPGTPDGAAGPGGSGGTGGLLFGVPGPSGPDG

SEQ ID NO: 168 - protein, 552 aa, Mycobacterium tuberculosis H37Rv
MAHFSVLPPEINSLRMYLGAGSAPMLQAAAAWDGLAAELGTAASSFSSVTTGLTGQAWQGPASAAMAAAAAPYAGFLTTASAQAQLAAGQAKAVASVFEAAKAAIVPPAAVAANREAFLALIRSNWLGLNAPWIAAVESLYEEYWAADVAAMTGYHAGASQAAAQLPLPAGLQQFLNTLPNLGIGNQGNANLGGGNTGSGNIGNGNKGSSNLGGGNIGNNNIGSGNRGSDNFGAGNVGTGNIGFGNQGPIDVNLLATPGQNNVGLGNIGNNNMGFGNTGDANTGGGNTGNGNIGGGNTGNNNFGFGNTGNNNIGIGLTGNNQMGINLAGLLNSGSGNIGIGNSGTNNIGLFNSGSGNIGVFNTGANTLVPGDLNNLGVGNSGNANIGFGNAGVLNTGFGNASILNTGLGNAGELNTGFGNAGFVNTGFDNSGNVNTGNGNSGNINTGSWNAGNVNTGFGIITDSGLTNSGFGNTGTDVSGFFNTPTGPLAVDVSGFFNTASGGTVINGQTSGIGNIGVPGTLFGSVRSGLNTGLFNMGTAISGLFNLRQLLG

SEQ ID NO: 169 - protein, 361 aa, Mycobacterium tuberculosis H37Rv
MSFLIASPEALAATATYLTGIGSAISAANAVAAAPTTEILAAGTDEVSTAISALFGAHAQAYQALSAHVAAFHDQFVHTLTAGAGSYMAAEAAAASPLQALQLELLNAINAPTLALLGRPLIGDGTDAAPGSGGAGGAGGILIGNGGTGGASDLAGTGRGGVGGAGGAGGLFGIGGAGGGCGSAVAIGGDGGAGGAGGVFSGGGAGGAGDAIGGSGGAGGTGGLLGGGGGAGGAGGAGGNGGGASNSASIGGDGGSGGAGGMLYGAGGVGGNGGAAVAIGGDGGAGGRAGAIGNGGDGGNGGTSNTPGGSGGDGGNGGNAGLIGNGGNGGNAEIVISGGSVAGTGGNGGLLLGFNGTNGLP

SEQ ID NO: 170 - protein, 484 aa, Mycobacterium tuberculosis H37Rv
AQASPAAHGGSGGAGGNGGAGSAGNGGAGGAGGNGGAGGNGGGGDAGNAGSGGNGGKGGDGVGPGSTGGAGGKGGAGANGGSSNGNARGGNAGNGGHGGAGGSGDTGGAGGAGGQGGFGGTGGSGSGIGGGAGGNGGNGGAGGTGVVLGGKGGDGGNGDHGGPATNPGSGSRGGAGGSGGNGGAGGNATGSGGKGGAGGNGGDGSFGATSGPASIGVTGAPGGNGGKGGAGGSNPNGSGGDGGKGGNGGAGGNGGSIGANSGIVGGSGGAGGAGGAGGNGSLSSGEGGKGGDGGHGGDGVGGNSSVTQGGSGGGGGAGGAGGSGFFGGKGGFGGDGGQGGPNGGGTVGTVAGGGGNGGVGGRGGDGVFAGAGGQGGLGGQGGNGGGSTGGNGGLGGAGGGGGNAPDGGFGGNGGKGGQGGIGGGTQSATGLGGDGGDGGDGGNGGNSGAKAGGAGGKGQAGQPNSGTEPGFGGDGGLGGAGATP

SEQ ID NO: 171 - protein, 2340 aa, Rickettsia prowazekii
MKKSKILRKFLATASLCGTLFTNSNATGTIIPNNGSVSLNTDAGLVGGVFNNGDIIQIVNGGREIKISADKANAIIGGINTLKELPDFGGVEVSQNVSIGPLNAGEDLNTNFGPLKFISNNVTSIITGVGTKTFSNIDFAGKNATLQINKDLNITTKIDNTVAGNNGSITFEGSGIISNHIGYTNSLLGINVGNGEAKIYAPEANNITINAKNINLTHNNSILTLCDGNITTLKGNINNTTEIDGQGILNLAYDLGSSSIITGDIGNIGSLDTINVLLGSATFNSTILKATNINLKHNTSTLNLDDNIIVIGNIKGNNNKDILNFKVHGTNLDNEMIIPAPQKTHGTLNFKGNATLNGNINNLNILKFSGGHGKTLNLQGNTKVDNLVFADSVLDSGTISVNGLLDTDCVTFNNSNVNGGTLIINAKNTISAKLLNATKAKIQINANLTMNHPSAGDISDIRIADNTIYTIDAKNGNVNLLNNNAKIIFEGADSMLALINTGVTADRTFTIYNNLNQSGNDEYGIVKIEAIKKVITIANQSGPYTIGQDNTHRLKELIVEGAGDIIIDDTIFTKLLSINSTGQITFNRTLDLGAGGNIAFGKHGTLVVNGVTGSITTSENNQGILTINSGNITGVIGTNELGLKLVNIGADPVTCSANVFASVALTNPSSVLILADGVTLTGEVTTHNNTKGVLSLGTGSNITGQIGTNSAALEKINIGAGASNIDSNIYAGSTVLTDQTSELTLNNDVVVNSNIITTAGNNSGKLIFTGNGGITGNIGANGAALQEVVFNGTTNIGGTANSQNFTVAHSAANVVITGLTTGALKYKDTGTIIAHGGLVGDIDFNNKAGKFILGDGAMIDGSVLCNGGVAGTLDFIGDGNVTQNIGADNANSISTINIQGDNTKNVTIANDIFVDNIHFTNGGILQLGGNLTTHNIDFGANGGTLEFNGNNTYNLNAIIVNGQNGILNAFTNLKASDDTIGTVKIINIGQIGTPQNFTIQVNNKNLTLVSSVNSSINFGDANSQLILSAPVDQTIKFINNLNETGGGIITLDSNGNNLTISGNNGIKLGSKGNELSSLNIKGKVTVTNDLDIQNIHQLNINNGALFDDQSLTSAKIKNINIGTVAGGATYTLDAINDNFDLNTSGMVFKHQDSILELKNSSNTNDHTITLTSALDPGNNQFGIIKLITDTNKLTIDNNGNVAYTLGTANHMLKQLTFASIDNGAIALKVGINVENVTLNIKDIELNEVNANVLFNKNTTYTATGNINGHVDFQGNAGVINLNDDIEIDGSVTSTGNVNGTLNFNGSGKVTGLINNIVMLQAGAGDVSLSASGNYSITEIQGNGNNNLTFAANSHLTTDINKTGGQDLNLVFINGGSVSGSIGANAAVGDIIINAGSVNFSNTLKSGNIVISDGATMQVNNNVTATDISGKNANNGTLKLNNHTPINITSTLGNNNAIGTIEVANNDVTITGTLQAQNIHFSNATQAATLTLGAASQVTNITTAGNNIHTLEVTDFDTGNDGIIGDANNRLKSIELTGNGTVTINSPHVYSSITTANNAQGNVKLNIEGGITYDLGSKIKSLANVQISEDTTIRGDVYSKYLNIDAGKTINFDRGDNNMNPKNLDIPDALIDLDVLPRSLSLFNYFTDIKADNLNFADDTATANFKDAVVIDAHIDNGGILKFNDNAWLTQEIKNANIIEIASDKFMLLQKNIKAATLIADNANLVLLDNVEVNTNLNVRDIVLDLANYELKYTGNVTHNGLLTIITYFDTALQKGGHILVSQGSNVDMSDLDNLIIKIKAHSDITNITSDTKHQIVKLETGAIYTPVPQTKVIIDASEEQNKFVKWVADANGLVLLTDTGGRDDTGGRDDTRGRGNTDNGCRDNCDVGNISNNSSNEAGGSSSDKNYGITDVVPIFDPSPILDYTKNNYVASGIANQLINHVKDFGNTTDAGKLLNDLGFMSPNRVTETLDRLSNRINVNGLNEGVVGLNGIEVENFLTDIAINMDNFTAKEIGNRLEELSDANTVNGLNKTNTLLNNKINLKRLNTNNQAIIAAGDEDNIVTGIWGMSFYGKIKQNSKNSASGYQSNTGGGIIGFDYNIDNSIVIGAAYTMADSKVKHKNDKNGDRTKAKSNIYSIYGLYNWLTNNFFVEAIGVYGRNKIKNYEKRITTITDQIAIGKFINTFYSYELLGGYNYLISHRTTITPMFGMRYATFKNNGYKENNTTFQNLSIKKNYYDKFETILGLNSVTHYLSQDIIIKPELHWFINYQCKNKLPNIDARLDGIDEPLTTIRFKPAKITYNLGGGISTKNNMIEFGIRYNLSLAKKYTAHQGSLKIKVNL

SEQ ID NO: 172 - protein, 1643 aa, Rickettsia prowazekii
MAQKPNFLKKIISAGLVTASTATIVAGFSGVAMGAAMQYNRTTNAAATTFDGIGFDQAAGANIPVAPNSVITANANNPITFNTPNGHLNSLFLDTANDLAVTINEDTTLGFITNIAQQAKFFNFTVAAGKILNITGQGITVQEASNTINAQNALTKVHGGAAINANDLSGLGSITFAAAPSVLEFNLINPTTQEAPLTLGANSKIVNGGNGTLNITNGFIQVSDNTFAGIKTINIDDCQGLMFNSTPDAANTLNLQVGGNTINFNGIDGTGKLVLVSKNGAATEFNVTGTLGGNLKGIIELNTAAVAGKLISQGGAANAVIGTDNGAGRAAGFIVSVDNGNAATISGQVYAKNMVIQSANAGGQVTFEHIVDVGLGGTTNFKTADSKVIITENSNFGSTNFGNLDTQIVVPDTKILKGNFIGDVKNNGNTAGVITFNANGALVSASTDPNIAVTNINAIEAEGAGVVELSGIHIAELRLGNGGSIFKLADGTVINGPVNQNALMNNNALAAGSIQLDGSAIITGDIGNGGVNAALQHITLANDASKILALDGANIIGANVGGAIHFQANGGTIKLTNTQNNIVVNFDLDITTDKTGVVDASSLTNNQTLTINGSIGTVVANTKTLAQLNIGSSKTILNAGDVAINELVIENNGSVQLNHNTYLITKTINAANQGQIIVAADPLNTNTTLADGTNLGSAENPLSTIHFATKAANADSILNVGKGVNLYANNITTNDANVGSLHFRSGGTSIVSGTVGGQQGHKLNNLILDNGTTVKFLGDTTFNGGTKIEGKSILQISNNYTTDHVESADNTGTLEFVNTDPITVTLNKQGAYFGVLKQVIISGPGNIVFNEIGNVGIVHGIAANSISFENASLGTSLFLPSGTPLDVLTIKSTVGNGTVDNFNAPIVVVSGIDSMINNGQIIGDKKNIIALSLGSDNSITVNANTLYSGIRTTKNNQGTVTLSGGMPNNPGTIYGLGLENGSPKLKQVTFTTDYNNLGSIIANNVTINDYVTLTTGGIAGTDFDAKITLGSVNGNANVRFVDSTFSDPRSMIVATQANKGTVTYLGNALVSNIGSLDTPVASVRFTGNDSGAGLQGNIYSQNIDFGTYNLTILNSNVILGGGTTAINGEIDLLTNNLIFANGTSTWGDNTSISTTLNVSSGNIGQVVIAEDAQVNATTTGTTTIKIQDNANANFSGTQAYTLIQGGARFNGTLGAPNFAVTGSNIFVKYELIRDSNQDYVLTRTNDVLNVVTTAVGNSAIANAPGVSQNISRCLESTNTAAYNNMLLAKDPSDVATFVGAIATDTSAAVTTVNLNDTQKTQDLLSNRLGTLRYLSNAETSDVAGSATGAVSSGDEAEVSYGVWAKPFYNIAEQDKKGGIAGYKAKTTGVVVGLDTLASDNLMIGAAIGITKTDIKHQDYKKGDKTDINGLSFSLYGSQQLVKNFFAQGNAIFTLNKVKSKSQRYFFESNGKMSKQIAAGNYDNMTFGGNLIFGYDYNAMPNVLVTPMAGLSYLKSSNENYKETGTTVANKRINSKFSDRVDLIVGAKVAGSTVNITDIVIYPEIHSFVVHKVNGKLSNSQSMLDGQTAPFISQPDRTAKTSYNIGLSANIKSDAKMEYGIGYDFNSASKYTAHQGTLKVRVNF

SEQ ID NO: 173 - protein, 2105 aa, Porphyromonas gingivalis W83
MARIILEAHDVWEDGTGYQMLWDADHNQYGASIPEESFWFANGTIPAGLYDPFEYKVPVNADASFSPTNFVLDGTASADIPAGTYDYVIINPNPGIIYIVGEGVSKGNDYVVEAGKTYHFTVQRQGPGDAASVVVTGEGGNEFAPVQNLQWSVSGQTVTLTWQAPASDKRTYVLNESFDTQTLPNGWTMIDADGDGHNWLSTINVYNTATHTGDGAMFSKSWTASSGAKIDLSPDNYLVTPKFTVPENGKLSYWVSSQEPWTNEHYGVFLSTTGNEAANFTIKLLEETLGSGKPAPMNLVKSEGVKAPAPYQERTIDLSAYAGQQVYLAFRHFGCTGIFRLYLDDVAVSGEGSSNDYTYTVYRDNVVIAQNLTATTFNQENVAPGQYNYCVEVKYTAGVSPKVCKDVTVEGSNEFAPVQNLTGSAVGQKVTLKWDAPNGTPNPNPGTTTLSESFENGIPASWKTIDADGDGNNWTTTPPPGGSSFAGHNSAICVSSASYINFEGPQNPDNYLVTPELSLPNGGTLTFWVCAQDANYASEHYAVYASSTGNDASNFANALLEEVLTAKTVVTAPEAIRGTRVQGTWYQKTVQLPAGTKYVAFRHFGCTDFFWINLDDVEIKANGKRADFTETFESSTHGEAPAEWTTIDADGDGQGWLCLSSGQLGWLTAHGGTNVVASFSWNGMALNPDNYLISKDVTGATKVKYYYAVNDGFPGDHYAVMISKTGTNAGDFTVVFEETPNGINKGGARFGLSTEANGAKPQSVWIERTVDLPAGTKYVAFRHYNCSDLNYILLDDIQFTMGGSPTPTDYTYTVYRDGTKIKEGLTETTFEEDGVATGNHEYCVEVKYTAGVSPKECVNVTVDPVQFNPVQNLTGSAVGQKVTLKWDAPNGTPNPNPGTTTLSESFENGIPASWKTIDADGDGNNWTTTPPPGGTSFAGHNSAICVSSASYINFEGPQNPDNYLVTPELSLPNGGTLTFWVCAQDANYASEHYAVYASSTGNDASNFANALLEEVLTAKTVVTAPEAIRGTRVQGTWYQKTVQLPAGTKYVAFRHFGCTDFFWINLDDVEIKANGKRADFTETFESSTHGEAPAEWTTIDADGDGQGWLCLSSGQLDWLTAHGGTNVVASFSWNGMALNPDNYLISKDVTGATKVKYYYAVNDGFPGDHYAVMISKTGTNAGDFTVVFEETPNGINKGGARFGLSTEANGAKPQSVWIERTVDLPAGTKYVAFRHYNCSDLNYILLDDIQFTMGGSPTPTDYTYTVYRDGTKIKEGLTETTFEEDGVATGNHEYCVEVKYTAGVSPKECVNVTVDPVQFNPVQNLTGSAVGQKVTLKWDAPNGTPNPNPGTTTLSESFENGIPASWKTIDADGDGNNWTTTPPPGGTSFAGHNSAICVSSASYINFEGPQNPDNYLVTPELSLPNGGTLTFWVCAQDANYASEHYAVYASSTGNDASNFANALLEEVLTAKTVVTAPEAIRGTRVQGTWYQKTVQLPAGTKYVAFRHFGCTDFFWINLDDVEIKANGKRADFTETFESSTHGEAPAEWTTIDADGDGQGWLCLSSGQLGWLTAHGGTNVVASFSWNGMALNPDNYLISKDVTGATKVKYYYAVNDGFPGDHYAVMISKTGTNAGDFTVVFEETPNGINKGGARFGLSTEANGAKPQSVWIERTVDLPAGTKYVAFRHYNCSDLNYILLDDIQFTMGGSPTPTDYTYTVYRDGTKIKEGLTETTFEEDGVATGNHEYCVEVKYTAGVSPKECVNVTINPTQFNPVQNLTAEQAPNSMDAILKWNAPASKRAEVLNEDFENGIPASWKTIDADGDGNNWTTTPPPGGSSFAGHNSAICVSSASYINFEGPQNPDNYLVTPELSLPGGGTLTFWVCAQDANYASEHYAVYASSTGNDASNFANALLEEVLTAKTVVTAPEAIRGTRVQGTWYQKTVQLPAGTKYVAFRHFGCTDFFWINLDDVVITSGNAPSYTYTIYRNNTQIASGVTETTYRDPDLATGFYTYGVKVVYPNGESAIETATLNITSLADVTAQKPYTLTVVGKTITVTCQGEAMIYDMNGRRLAAGRNTVVYTAQGGHYAVMVVVDGKSYVEKLAVK

SEQ ID NO: 174 - protein, 2204 aa, Porphyromonas gingivalis W83
MKTSERILSYFFLLCAVFSLGSCEGLYAQVTFPNYSPTAASSIAVCSGEETLIIDFTVVQEDSNGIKVNVKLADGVEYVVGTAVVSVTQGNAVTVAETNVSNPNEPVFTVKSADGNNVVELGTIVKLTIKRRAVCTAWSNAINAAETGFVFKDKVTVTIGDHSDSKESNSYSVNYPNLTIKQPAPQVNKQIGETIVREFSITNGSQNPTQTVYLSIEYPDEAYLTGVGAMTLQAKLGASGTYADLTPTVTNGKVRIYTLSGSSLGPDHLLTNGEIIYLKETFKLKTCAPVTVYRVGWGCSIDSQCEIKTTAATITMAAGAANITGYSVTGPDYRSPTFSLCQPFELTIKFSNSGAGGSMGAAFNINTIGRNDYYRPRGFVLHEFIDVKVNGKPVTNFKTDGSELDLRFDGQFTEDPDGPGVGLDDVDGDGFYDDLPVGATITITVTVRLKCDQFTACNNAPNDLSDRGLILKTLYQTSCDRTSWIDPNTWFNLSSTHLYLSRESVQDASHMPTVIEKDTPFDLKIMTSYYSILSSYNNIWYANPNTRYVVEIVFPQGMTMPPKSDIEWTNIKNHPIDGSLVFTPPINLPDANITTSGNTMTIVSPSQERGFVTLHGVKYDCTNNHEMVVEYKIREVFNYLHFPDCLCPVGPIMCNTAKRYVLGCDPPCGRGAETSVPKIERADNSLGWTDYTMRTRQSRSNISAYDLAKALYMDEVNITATSIQHGTASSLGARFVLATGVDRVETLTPLSADIKIFRDGVQIVSVDGYTTFRSIRRNNNAEQVIDWDFTSILPAGGLLDRDKVDVVTRYRVTSQNAHRVDTQVGREWFFYNSTANVSPIWDEANPLTCLILVPEIYIMGTFVVNGTDPHVISQCTPTDLGRVANHYARRFGSGAFEYANEYRPGVKIRNIYLKVPKSYTLNRVEYSNHRNHSSLGTTMPFEEINHTDVTSQGEYNIYKYQLADNEKAHFNITVKNAYGAALKVNVSPTCASSAVATNYDKISYYVDYIDYYYYAATQPTVPNSLDIVADQSAGSNGIYSVSALNVYNRPILYTNKPSIALVNQSGEVELVGKTGEWKLRISNPSSATAPYVWLALPTTSGLTIEKVTDAAGTEMAFTTYSGGKMYRLSEAGVPVGSALDYTIHFTYSGCSPIALKAMGGWNCSAYPLSLDEYVCSSQVIDLKLKPLPAAMELTEIAVPDPTAAATLCSTLEYIYSIQSTDNANVYSPTFSIFPEEGLVVTPNQVQVEYPAGSGNWAALNVVNNSVNLLQHPALTTIGYLKGLKEGESNDNQRKILVKFYIKTECSFVSGKNFRVRADGRNACNQNAKGSGLAISTPPIRINGAIEPYTTSASTQLVTTTTSQSDCKAPKRVKVVQTVVGGETTPKAYLEITLPLGFKYVTGSYAPDNTHPGGVNASPAGTEEVTLTANGEDKIKINVKAGLTSGQSFAYTLEMKEDDDNVPACGNHTIEIVNVEEIEGLWCEGVQCAETLVVTGANKFEFELDKPYLDITVISAVSTFSGGKENLTIEYKVSNTSTTQPLKPGAVVTLFSDKDNNQVFSGGDVAVATQELVAEITNTTPLTQIMKVKGVSSSHTGNLVLTILPKDGCYCEIKSPMVTLNHLPSNYWIGGTVGKPNEWKEPNNWTNDQVPDAAEDVEFATEVNNPTDPNNPKSGPAKENLHLDDIHQNGTAGRVIGNLINDSDKDLVITTGNQLTINGVVEDNNPNVGTIVVKSSKDNPTGTLLFANPGNNQNVGGTVEFYNQGYDCADCGMYRRSWQYFGIPVNESDFPYDHVDGNATVNQWVEPFNGDKWRPAPYAPDTKLQKFKGYQITNDVQAQPTGVYSFKGTLCVCDAFLNLTRTSGVNYSGANLIGNSYTGAIDIKQGIVFPPEVEQTVYLFNTGTRDQWRKLNGSTVSGYRAGQYLSVPKNTAGQDNLPDRIPSMHSFLVKMQNGASCTLQILYDKLLKNTTVNNGNGTQITWRSGNSGSANMPSLVMDVLGNESADRLWIFTDGGLSFGFDNGWDGRKLTEKGLSQLYAMSDIGNDKFQVAGVPELNNLLIGFDADKDGQYTLEFALSDHFAKGGVFLEDLSRGVTRRVVDGGSYSFDAKRGDSGARFRLSYDEEWVESAEVSVLVGTAGKRIVITNNSEHACQANVYTTDGKLLIRLDVKPGSKSMTEPLVDGVYVVSLQSPATSSNVRKVVVN

SEQ ID NO: 175 - protein, 940 aa, Porphyromonas gingivalis W83
MNKFYKSLLQSGLAAFVSMATALTASAQISFGGEPLSFSSRSAGTHSFDDAMTIRLTPDFNPEDLIAQSRWQSQRDGRPVRIGQVIPVDVDFASKASHISSIGDVDVYRLQFKLEGAKAITLYYDAFNIPEGGRLYIYTPDHEIVLGAYTNATHRRNGAFATEPVPGSELIMDYEVSRGGTLPDIKISGAGYIFDKVGGRPVTDNHYGIGEDDSDSDCEININCPEGADWQAEKNGVVQMIMVKGQYISMCSGNLLNNTKGDFTPLIISAGHCASITTNFGVTQSELDKWIFTFHYEKRGCSNGTLAIFRGNSIIGASMKAFLPIKGKSDGLLLQLNDEVPLRYRVYYNGWDSTPDIPSSGAGIHHPAGDAMKISILKKTPALNTWISSSGSGGTDDHFYFKYDQGGTEGGSSGSSLFNQNKHVVGTLTGGAGNCGGTEFYGRLNSHWNEYASDGNTSRMDIYLDPQNNGQTTILNGTYRDGYKPLPSVPRLLLQSTGDQVELNWTAVPADQYPSSYQVEYHIFRNGKEIATTKELSYSDAIDESIIGSGIIRYEVSARFIYPSPLDGVESYKDTDKTSADLAIGDIQTKLKPDVTPLPGGGVSLSWKVPFLSQLVSRFGESPNPVFKTFEVPYVSAAAAQTPNPPVGVVIADKFMAGTYPEKAAIAAVYVMPSAPDSTFHLFLKSNTNRRLQKVTTPSDWQAGTWLRINLDKPFPVNNDHMLFAGIRMPNKYKLNRAIRYVRNPDNLFSITGKKISYNNGVSFEGYGIPSLLGYMAIKYLVVNTDAPKIDMSLVQEPYAKGTNVAPFPELVGIYVYKNGTFIGTQDPSVTTYSVSDGTESDEYEIKLVYKGSGISNGVAQIENNNAVVAYPSVVTDRFSIKNAHMVHAAALYSLDGKQVRSWNNLRNGVTFSVQGLTAGTYMLVMQTANGPVSQKIVKQ

SEQ ID NO: 176 - protein, 1706 aa, Porphyromonas gingivalis W83
MKNLNKFVSIALCSSLLGGMAFAQQTELGRNPNVRLLESTQQSVTKVQFRMDNLKFTEVQTPKGMAQVPTYTEGVNLSEKGMPTLPILSRSLAVSDTREMKVEVVSSKFIEKKNVLIAPSKGMIMRNEDPKKIPYVYGKSYSQNKFFPGEIATLDDPFILRDVRGQVVNFAPLQYNPVTKTLRIYTEITVAVSETSEQGKNILNKKGTFAGFEDTYKRMFMNYEPGRYTPVEEKQNGRMIVIVAKKYEGDIKDFVDWKNQRGLRTEVKVAEDIASPVTANAIQQFVKQEYEKEGNDLTYVLLIGDHKDIPAKITPGIKSDQVYGQIVGNDHYNEVFIGRFSCESKEDLKTQIDRTIHYERNITTEDKWLGQALCIASAEGGPSADNGESDIQHENVIANLLTQYGYTKIIKCYDPGVTPKNIIDAFNGGISLANYTGHGSETAWGTSHFGTTHVKQLTNSNQLPFIFDVACVNGDFLFSMPCFAEALMRAQKDGKPTGTVAIIASTINQSWASPMRGQDEMNEILCEKHPNNIKRTFGGVTMNGMFAMVEKYKKDGEKMLDTWTVFGDPSLLVRTLVPTKMQVTAPAQINLTDASVNVSCDYNGAIATISANGKMFGSAVVENGTATINLTGLTNESTLTLTVVGYNKETVIKTINTNGEPNPYQPVSNLTATTQGQKVTLKWDAPSTKTNATTNTARSVDGIRELVLLSVSDAPELLRSGQAEIVLEAHDVWNDGSGYQILLDADHDQYGQVIPSDTHTLWPNCSVPANLFAPFEYTVPENADPSCSPTNMIMDGTASVNIPAGTYDFAIAAPQANAKIWIAGQGPTKEDDYVFEAGKKYHFLMKKMGSGDGTELTISEGGGSDYTYTVYRDGTKIKEGLTATTFEEDGVAAGNHEYCVEVKYTAGVSPKVCKDVTVEGSNEFAPVQNLTGSAVGQKVTLKWDAPNGTPNPNPNPNPNPNPGTTTLSESFENGIPASWKTIDADGDGHGWKPGNAPGIAGYNSNGCVYSESFGLGGIGVLTPDNYLITPALDLPNGGKLTFWVCAQDANYASEHYAVYASSTGNDASNFTNALLEETITAKGVRSPEAIRGRIQGTWRQKTVDLPAGTKYVAFRHFQSTDMFYIDLDEVEIKANGKRADFTETFESSTHGEAPAEWTTIDADGDGQGWLCLSSGQLDWLTAHGGTNVVSSFSWNGMALNPDNYLISKDVTGATKVKYYYAVNDGFPGDHYAVMISKTGTNAGDFTVVFEETPNGINKGGARFGLSTEADGAKPQSVWIERTVDLPAGTKYVAFRHYNCSDLNYILLDDIQFTMGGSPTPTDYTYTVYRDGTKIKEGLTETTFEEDGVATGNHEYCVEVKYTAGVSPKKCVNVTVNSTQFNPVKNLKAQPDGGDVVLKWEAPSAKKTEGSREVKRIGDGLFVTIEPANDVRANEAKVVLAADNVWGDNTGYQFLLDADHNTFGSVIPATGPLFTGTASSDLYSANFEYLIPANADPVVTTQNIIVTGQGEVVIPGGVYDYCITNPEPASGKMWIAGDGGNQPARYDDFTFEAGKKYTFTMRRAGMGDGTDMEVEDDSPASYTYTVYRDGTKIKEGLTETTYRDAGMSAQSHEYCVEVKYTAGVSPKVCVDYIPDGVADVTAQKPYTLTVVGKTITVTCQGEAMIYDMNGRRLAAGRNTVVYTAQGGYYAVMVVVDGKSYVEKLAIK

SEQ ID NO: 177 - protein, 484 aa, Porphyromonas gingivalis W83
MKRKPLFSALVILSGFFGSVHPASAQKVPAPVDGERIIMELSEADVECTIKIEAEDGYANDIWADLNGNGKYDSGERLDSGEFRDVEFRQTKAIVYGKMAKFLFRGSSAGDYGATFIDISNCTGLTAFDCFANLLTELDLSKANGLTFVNCGKNQLTKLDLPANADIETLNCSKNKITSLNLSTYTKLKELYVGDNGLTALDLSANTLLEELVYSNNEVTTINLSANTNLKSLYCINNKMTGLDVAANKELKILHCNNNQLTALNLSANTKLTTLSFFNNELTNIDLSDNTALEWLFCNGNKLTKLDVSANANLIALQCSNNQLTALDLSKTPKLTTLNCYSNRIKDTAMRALIESLPTITEGEGRFVPYNDDEGGEEENVCTTEHVEMAKAKNWKVLTSWGEPFPGITALISIEGESEYSVYAQDGILYLSGMEQGLPVQVYTVGGSMMYSSVASGSAMEIQLPRGAAYVVRIGSHAIKTAMP

SEQ ID NO: 178 - protein, 300 aa, Shigella flexneri 2a str. 2457T
MKRAITLFAVLLMGWSVNAWSFACKTANGTAIPIGGGSANVYVNLAPVVNVGQNLVVDLSTQIFCHNDYPETITDYVTLQRGSAYGGVLSNFSGTVKYSGSSYPFPTTSETPRVVYNSRTDKPWPVALYLTPVSSAGGVAIKAGSLIAVLILRQTNNYNSDDFQFVWNIYANNDVVVPTGGCDVSARDVTVTLPDYPGSVPIPLTVYCAKSQNLGYYLSGTTADAGNSIFTNTASFSPAQGVGVQLTRNGTIIPANNTVSLGAVGTSAVSLGLTANYARTGGQVTAGNVQSIIGVTFVYQ

SEQ ID NO: 179 - protein, 955 aa, Shigella flexneri 2a str. 2457T
MGIKQHNGNTKADRLAELKIRSPSIQLIKFGAIGLNAIIFSPLLIAADTGSQYGTNITINDGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKIKTDGSTGVYIGGLNGNNANGAARFTATDLTIDVQGYSAMGINVQKNSVVDLGTNSTIKTNGDNAHGLWSFGQVSANALTVDVTGAAANGVEVRGGTTTIGADSHISSAQGGGLVTSSSDATINFSGTAAQRNSIFSGGSYGASAQTATAVINMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFTTLNVENLSGNSTFIMRADVVGEGNGVNNRGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPAPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIDSTHASPDYSGGDGTARSDYMGMYASYMAQNGFYSDLVIKASRQKNSFHVLDSQNNGVNANGTANGMSISLEAGQRFNLSPTGYGFYIEPQTQLTYSHQNEMAMKASNGLNIHLNHYESLLGRASMILGYDITAGNSQLNVYVKTGAIREFSGDTEYLLNDSREKYSFKGNGWNNGVGVSAQYNKQHTFYLEADYTQGNLFDQKQVNGGYRFSF

SEQ ID NO: 180 - protein, 187 aa, Shigella flexneri 2a str. 2457T
MSKFVKTAIAAAMVMGVFTSTATIAAGNNGTARFYGTIEDSVCSIVPDDHKLEVDMGDIGAEKLKNNGTTTPKSFQIRLQDCVFDTQETMTTTFTGTVSSANSGNYYTIFNTDTGAAFNNVSLAIGDSLGTSYKSGMGIDQKIVKDTSTNKGKAKQTLNFNAWLVGAADAPDLGNFEANTTFQITYL

SEQ ID NO: 181 - protein, 182 aa, Shigella flexneri 2a str. 2457T
MKIKTLAIVVLSALSLSSAAALADTTTVNGGTIHFKGEVVNAACAVDAGSVDQTVQLGQVRTASLKQAGATSSAVGFNIQLNDCDTTVATKAAVAFLGTAIDATRTDVLALQSSAAGSATNVGVQILDRTGNALTLDGATFSAQTTLNNGTNTIPFQARYYAIGEATPGAANADATFKVQYQ

SEQ ID NO: 182 - protein, 468 aa, Shigella flexneri 2a str. 2457T
MASISSLGVGSGLDLSSILDSLTAAQKATLTPISNQQSSFTAKLSAYGTLKSALTTFQTANTALSKADLFSATSTTSSTTAFSATTAGNAIAGKYTISVTHLAQAQTLTTRTTRDDTKTAIATSDSKLTIQQGDDKDPITIDISAANSSLSGIRDAINNAKAGVSASIINVGNGEYRLSVTSNDTGLDNAMTLSVSGDDALQSFMGYDASASSNGMEVSVAAQNAQLTVNNVAIENSSNTISDALENITLNLNDVTTGNQTLTITQDTSKVQTAIKDWVNAYNSLIDTFSSLTKYTAVDAGADSQSSSNGALLGDSTLRTIQTQLKSMLSNTVSSSSYKTLAQIGITTDPSDGKLELDADKLTAALKKDASGVGALIVGDGKKTGITTTIGSNLTSWLSTTGIIKAATDGVSKTLNKLTKDYNAASDRIDAQVARYKEQFTQLDVLMTSLNSTSSYLTQQFENNSNSK

SEQ ID NO: 183 - protein, 706 aa, Shigella flexneri 2a str. 2457T
MEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGALTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFIQGNKLQAGAFNYSLNRDSDESWYLRSENAYRAEVPLYASMLTQAMDYDRILAGSRSHQTGVSGENNSVRLSIQGGHLGHDNNGGIARGATPESSGSYGFVRLEGDLLRTEVAGMSVTAGVYGAAGHSSVDVKDDDGSRAGTVRDDAGSLGGYLNLIHNASGLWADIVAQGTRHSMKASSDNNDFRVRGWGWLGSLETGLPFSITDNLMLEPQLQYTWQGLSLDDGQDNASYVKFGHGSAQHVRAGFRLGSHHDMNFGKGTSSRDTLRGSAKHSVRELPVNWWVQPSVIRTFSSRGDMSMGTAAAGSNMTFSPSQNGTSLDLQAGLEARVRENITLGVQASYAHSINGSSAEGYNSQATLNVTF

SEQ ID NO: 184 - protein, 402 aa, Shigella flexneri 2a str. 2457T
MAFSQAVSGLNAAATNLDVIGNNIANSATYGFKSGTASFADMFAGSKVGLGVKVAGITQDFTDGTTTNTGRGLDVAISQNGFFRLVDSNGSVFYSRNGQFKLDENRNLLNTQGLQLTGYPVTGTPPTIQQGANPTNISIPNTLMAAKTTTTASMQINLNSSDPLPTVTPFSASNADSYNKKGSVTVFDSQGNAHDMSVYFVKTGDNNWQVYTQDSSDPNSIAKTATTLEFNANGTLVDGAMANNIATGAINGAEPATFSLSFLNSMQQNTGANNIVATTQNGYKPGDLVSYQINDDGTVVGNNSNEQTQLLGQIVLANFANNEGLASEGDNVWSATQSSGVALLGTAGTGNFGTLTNGALEASNVDLSKELVNMIVAQRNYKSNAQTIKTQDQILNTRVNLR

SEQ ID NO: 185 - protein, 190 aa, Shigella flexneri 2a str. 2457T
MKLVHMASGLAVAIALAACADKSADIQTPAPAANTSISATQQPAIQQPNVSGTVWIRQKVALPPDAVLTVTLSDASLADAPSKVLAQKAVRTEGKQSPFSFVLPFNPADVQPNARILLSAAITVNDKLVFITDTVQPVINQGGTKADLTLVPVQQTAVPVQASGGATTTVPSTSPTQVNPSSAVPAPTQY

SEQ ID NO: 186 - protein, 232 aa, Shigella flexneri 2a str. 2457T
MIIKKSGGRWQLSLLASVVISAFFLNTAYAWQQEYIVDTQPGHSTERYTWDSDHQPDYNDILSQRIQSSQRALGLEVNLAEETPVDVTSSMSMGWNFPLYEQVTTGPVAALHYDGTTTSMYNEFGDSTTTLTDPLWHASVSSLGWRVDSRLGDLRPWAQISYNQQFGENIWKAQSGLSRMTATNQNGNWLDVTVGADMLLNQNIAAYAALTQAENTTNNSDYLYTMGVSARF

SEQ ID NO: 187 - protein, 167 aa, Shigella flexneri 2a str. 2457T
MKWCKRGYVLAAMLALASATIQAADVTITVNGKVVAKPCTVSTTNATVDLGDLYSFSLMSAGAASAWHDVALELTNCPVGTSRVTASFSGAADSTGYYKNQGTAQNIQLELQDDSGNTLNTGATKTVQVDDSSQSAHFPLQVRALTVNGGATQGTIQAVISITYTYS

SEQ ID NO: 188 - protein, 363 aa, Shigella flexneri 2a str. 2457T
MKRAPLITGLLLISTSCAYASSGGCGADSTSGATNYSSVVDDVTVNQTDNVTGREFTSATLSSTNWQYACSCSAGKAVKLVYMVSPVLTTTGHQTGYYKLNDSLDIKTTLQANDIPGLTTDQVVSVNTRFTQIKSSTVYSAATQTGVCQGDTSRYGPVNIGANTTFTLYVTKPFLGSMTIPKTDIAVIKGAWVDGMGSPSTGDFHDLVKLSIQGNLTAPQSCKINQGDVIKVNFGFINGQKFTTRNAMPDGFTPVDFDITYDCGDTSKIKNSLQMRIDGTTGVVDQYNLVARRRSSDNVPDVGIRIENLGGGVANIPFQNGILPVDPSGHGTVNMRAWPVNLVGGELETGKFQGTATITVMVR

SEQ ID NO: 189 - protein, 232 aa, Shigella flexneri 2a str. 2457T
MQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 190 - protein, 297 aa, Shigella flexneri 2a str. 2457T
MKRHLNTCYRLVWNHITGAFVVASELARAQGKRGGVAVALSLAAVTSLPVLAADIVVHPGETVNGGTLVNHDNQFVSGTADGVTVSTGLELGPDSDENTGGQWIKAGGTGRNTTVTANGRQIVQAGGTASDTVIRDGGGQSLNGLAVNTTLDNRGEQWVHGGGKAAGTIINQDGYQTIKHGGLATGTIVNTGAEGGPESENVSSGQMVGGTAESTTINKNGRQVIWSSGMARDTLIYAGGDQTVHGEAHNTRLEGGNQYVHNGGTATETLINRDGWQVIKEGGTAAHTTINQKESCR

SEQ ID NO: 191 - protein, 165 aa, Shigella flexneri 2a str. 2457T
MMMKTIKHLLCCAIAASALISTGVHAASWKDALSSAASELGNQNSTTQEGGWSLASLTNLLSSGNQALSADNMNNAAGILQYCAKQKLASVTDAENIKNQVLEKLGLNSEEQKEDTNYLDGIQGLLKTKDGQQLNLDNIGTTPLAEKVKTKACDLVLKQGLNFIS

SEQ ID NO: 192 - protein, 188 aa, Shigella flexneri 2a str. 2457T
MFKGQKTLAALAVSLLFTAPVYAADEGSGEIHFKGEVIEAPCEIHQDDIDKEVELGQVTTSHINQSHHSDAVAVDLLLVNCDLENSSNGSGGKISKVAVTFDSSAKTTGADPILNNTSTGEATGVGVRLMNKDQSNIVLGTATPDIDLAPTSSEQTLNFFAWMEQIDQATPVTPGAVTANATYVLDYK

SEQ ID NO: 193 - protein, 379 aa, Shigella flexneri 2a str. 2457T
MSAGSPKFTVRRIAALSLVSLWLAGCSDTSNPPAPVSSVNGNAPANTNSGMLITPPPKMGTTSTAQQPQIQPVQQPQIQATQQPQIQPVQPVAQQPVQMENGRIVYNRQYGNIPKGSYSGSTYTVKKGDTLFYIAWITGNDFRDLAQRNNIQAPYALNVGQTLQVGNASGTPITGGNAITQADAAEQGVVIKPAQNSTVAVASQPTITYSESSGEQSANKMLPNNKPTATTVTAPVTVPTASTTEPTVSSTSTSTPISTWRWPTEGKVIETFGASEGGNKGIDIAGSKGQAIIATADGRVVYAGNALRGYGNLIIIKHNDDYLSAYAHNDTMLVREQQEVKAGQKIATMGSTGTSSTRLHFEIRYKGKSVNPLRYLPQR

SEQ ID NO: 194 - protein, 365 aa, Shigella flexneri 2a str. 2457T
MIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 195 - protein, 174 aa, Shigella flexneri 2a str. 2457T
MKRSIIAAAVFSSFFMSAGVFAADVDTGTLTIKGNIAESPCKFEAGGDSVSINMPTVPTTVFEGKAKYSTYDDAVGVTSSMLKISCPKEVAGVKLSLITNDKITGNDKAIASSNDTVGDNSDVLDVSAPFNIESYKTAEGQYAIPFKAKYLKLTDNSVQSGDVLSSLVMRVAQD

SEQ ID NO: 196 - protein, 193 aa, Shigella flexneri 2a str. 2457T
MAVQKNVIKGILAGTFALMLSGCVTVPDAIKGSSTTPQQDLVRVMSAPQLYVGQEARFGGKVVAVQNQQGKTRLEIATVPLDSGARPTLGEPSRGRIYADVNGFLDPVDFRGQLVTVVGPITGAVDGKIGNTPYKFMVMQVTGYKRWHLTQQVIMPPQPIDPWFYGGRGWPYGYGGWGWYNPGPARVQTVVTE

SEQ ID NO: 197 - protein, 176 aa, Shigella flexneri 2a str. 2457T
MRNKPFYLLCAFLWLAVSRVLAADSTITIRGYVRDNGCSVAAESTNFTVDLMENAAKQFNNIGATTPVVPFRILLSPCGNAVSAVKVGFTGVADSHNANLLALENTVSAAAGLGIQLLNEQQNQIPLNAPSSAISWTTLTPGKPNTLNFYARLMATQVPVTAGHINATATFTLEYQ

SEQ ID NO: 198 - protein, 212 aa, Shigella flexneri 2a str. 2457T
MKKLTVAALAVTTLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTANYKLGGAQQHDSVRLDPWVFMFSAGYRF

SEQ ID NO: 199 - protein, 259 aa, Shigella flexneri 2a str. 2457T
MFFKRGKILSAGRLNKKSLGIVMFLSVGLLLAGCSGSKSSDTGTYSGSVYTVKRGDTLYRISRTTGTSVKELARLNGISPPYTIEVGQKLKLGGAKSSSSTRKSTAKSTTKTASVTPSSAVPKSSWPPVGQRCWLWPTTGKVIMPYSTADGGNKGIDISAPRGTPIYAAGAGKVVYVGNQLRGYGNLIMIKHSEDYITAYAHNDTMLVNNGQSVKAGQKIATMGSTDAASVRLHFQIRYRATAIDPLRYLPPQGSKPKC

SEQ ID NO: 200 - protein, 550 aa, Shigella flexneri 2a str. 2457T
MAQVINTNSLSLITQNNINKNQSALSSSIERLSSGLRINSAKDDAAGQAIANRFTSNIKGLTQAARNANDGISVAQTTEGALSEINNNLQRIRELTVQASTGTNSDSDLDSIQDEIKSRLDEIDRVSGQTQFNGVNVLAKDGSMKIQVGANDGQTITIDLKKIDSDTLGLNGFNVNGGGAVANTAASKADLVAANATVVGNKYTVSAGYDAAKASDLLAGVSDGDTVQATINNGFGTAASATNYKYDSASKSYSFDTTTASAADVQKYLTPGVGDTAKGTITIDGSAQDVQISSDGKITASNGDKLYIDTTGRLTKNGSGASLTEASLSTLAANNTKATTIDIGGTSISFTGNSTTPDTITYSVTGAKVDQAAFDKAVSTSGNNVDFTTAGYSVNGTTGAVTKGVDSVYVDNNEALTTSDTVDFYLQDDGSVTNGSGKAVYKDADGKLTTDAETKAATTADPLKALDEAISSIDKFRSSLGAVQNRLDSAVTNLNNTTTNLSEAQSRIQDADYATEVSNMSKAQIIQQAGNSVLAKANQVPQQVLSLLQG

SEQ ID NO: 201 - protein, 171 aa, Shigella flexneri 2a str. 2457T; identical to SEQ ID NO: 59

SEQ ID NO: 202 - protein, 190 aa, Shigella flexneri 2a str. 2457T
MKRNIIGGAFTLASLMLAGHALAEDGVVNFVGEIVDTTCEVTSDTADQIVPLGKVSKNAFSGVGSLASPQKFSIKLENCPATYTQAAVRFDGTEAPGGDGDLKVGTPLTAGNPGDFTGTGQAIAATGVGIRIFNQSDNSQVKLYNDSAYTAIDAEGKAEMKFIARYVATNATVTAGTANADSQFTVEYKK

SEQ ID NO: 203 - protein, 351 aa, Shigella flexneri 2a str. 2457T
MKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDTVAVGMTYQF

SEQ ID NO: 204 - protein, 362 aa, Shigella flexneri 2a str. 2457T
MRKQWLGICIAAGMLAACTSDDGQQQTVSVPQPAVCNGPIVEISGADPRFEPLNATANQDYQRDGKSYKIVQDPSRFSQAGLAAIYDAEPGSNLTASGEAFDPTKLTAAHPTLPIPSYARITNLANGRMIVVRINDRGPYGNDRVISLSRAAADRLNTSNNTKVRIDPIIVAQDGSLSGPGMACTTVAKQTYALPAPPDLSGGAGTSSVSGPQGDILPVSNSTLKSEDPTGAPVTSSGFLGAPTTLAPGVLEGSEPTPAPQPVVTASSTTPATSPAMVTPQAASQSASGNFMVQVGAVSDQARAQQYQQQLGQKFGVPGRVTQNGAVWRIQLGPFASKAEASTLQQRLQTEAQLQSFITTAQ

SEQ ID NO: 205 - protein, 180 aa, Shigella flexneri 2a str. 2457T
MKKKTIYQCVILFFSLLNIHVGMAGPEQVSMHIYGNVVDQGCDVATKSALQNIHIGDFNISDFQAANTVSTAADLNIDITGCAAGITGADVLFSGEADTLAPTLLKLTDTGGSGGMATGIAVQILDAQSQQEIPLNQVQPLTPLKAGDNTLKYQLRYKSTKAGATGGNATAVLYFDLVYQ

SEQ ID NO: 206 - protein, 151 aa, Shigella flexneri 2a str. 2457T
MKNKLLFMMLTILGAPGIAAAAGYDLANSEYNFAVNELSKSSFNQAAIIGQAGTNNSAQLRQGGSKLLAVVAQEGSSNRAKIDQTGDYNLAYIDQAGSANDASISQGAYGNTAMIIQKGSGNKANITQYGTQKTAVVVQRQSQMAIRVTQR

SEQ ID NO: 207 - protein, 172 aa, Shigella flexneri 2a str. 2457T
MMKFKKCLLPVAMLASFTLAGCQSNADDHAADVYQTDQLNTKQETKTVNIISILPAKVAVDNSQNKRNAQAFGALIGAVAGGVIGHNVGSGSNSGTTAGAVGGGAVGAAAGSMVNDKTLVEGVSLTYKEGTKVYTSTQEGKECQFTTGLAVVITTTYNETRIQPNTKCPEKS

SEQ ID NO: 208 - protein, 183 aa, Shigella flexneri 2a str. 2457T
MQTKKNEIWVGIFLLAALLAALFVCLKAANVTSIRTESTYTLYATFDNIGGLKARSPVSIGGVVVGRVADITLDPKTYLPRVTLEIEQRYNHIPDTSSLSIRTSGLLGEQYLALNVGFEDPELGTAILKDGDTIQDTKSAMVLEDLIGQFLYGSKGDDNKNSGDAPAAAPGNNETTEPVGTTK

SEQ ID NO: 209 - protein, 525 aa, Shigella flexneri 2a str. 2457T
MAPLAFSAQSLAESLTVEQRLELLEKALRETQSELKKYKDEEKKKYTPATVNRSVSTNDQGYAANPFPTSSAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAVVMIDGNVGQQYSTGWFGDNAGGENFMQFSDMYVTTKGFLPFAPEADFWVGKHGAPKIEIQMLDWKTQRTDAAAGVGLENWKVGPGKIDIALVREDVDDYDRSLQNKQQINTHTIDLRYKDIPLWDKATLMVSGRYVTANESASEKDNQDNNGYYDWKDTWMFGTSLTQKFDKGGFNEFSFLVANNSIARNFGRYAGASPFTTFNGRYYGDHTGGTAVRLTSQGEAYIGDHFIVANAIVYSFGNNIYSYETGAHSDFESIRAVVRPAYIWDQYNQTGVELGYFTQQNKDANSNKFNESGYKTTLFHTFKVNTSMLTSRLEIRFYATYIKALENELDGFTFEDNKDAQFAVGAQAEIWW

SEQ ID NO: 210 - protein, 431 aa, Streptococcus mutans UA159
MKKRILSAVLVSGVTLSSATTLSAVKADDFDAQIASQDSKINNLTAQQQAAQAQVNTIQGQVSALQTQQAELQAENQRLEAQSATLGQQIQTLSSKIVARNESLKQQARSAQKSNAATSYINAIINSKSVSDAINRVSAIREVVSANEKMLQQQEQDKAAVEQKQQENQAAINTVAANQETIAQNTNALNTQQAQLEAAQLNLQAELTTAQDQKATLVAQKAAAEEAARQAAAAQAAAEAKAAAEAKALQEQAAQAQAAANNNTQATDVSDQQAAAADNTQAAQTGDSTEQSAAQAVNNSDQESTTATEAQPSASSASTAAVAANTSSANTYPAGQCTWGVKSLAPWVGNYWGNGGQWAASAAAAGYRVGSTPSAGAVAVWNDGGYGHVAYVTGVQGGQIQVQEANYAGNQSIGNYRGWFNPGSVSYIYPN

SEQ ID NO: 211 - protein, 1562 aa, Streptococcus mutans UA159
MKVKKTYGFRKSKISKTLCGAVLGTVAAVSVAGQKVFADETTTTSDVDTKVVGTQTGNPATNLPEAQGSASKEAEQSQNQAGETNGSIPVEVPKTDLDQAAKDAKSAGVNVVQDADVNKGTVKTAEEAVQKETEIKEDYTKQAEDIKKTTDQYKSDVAAHEAEVAKIKAKNQATKEQYEKDMAAHKAEVERINAANAASKTAYEAKLAQYQADLAAVQKTNAANQAAYQKALAAYQAELKRVQEANAAAKAAYDTAVAANNAKNTEIAAANEEIRKRNATAKAEYETKLAQYQAELKRVQEANAANEADYQAKLTAYQTELARVQKANADAKAAYEAAVAANNAKNAALTAENTAIKQRNENAKATYEAALKQYEADLAAVKKANAANEADYQAKLTAYQTELARVQKANADAKAAYEAAVAANNAANAALTAENTAIKKRNADAKADYEAKLAKYQADLAKYQKDLADYPVKLKAYEDEQASIKAALAELEKHKNEDGNLTEPSAQNLVYDLEPNANLSLTTDGKFLKASAVDDAFSKSTSKAKYDQKILQLDDLDITNLEQSNDVASSMELYGNFGDKAGWSTTVSNNSQVKWGSVLLERGQSATATYTNLQNSYYNGKKISKIVYKYTVDPKSKFQGQKVWLGIFTDPTLGVFASAYTGQVEKNTSIFIKNEFTFYDEDGKPINFDNALLSVASLNRENNSIEMAKDYTGKFVKISGSSIGEKNGMIYATDTLNFRQGQGGARWTMYTRASEPGSGWDSSDAPNSWYGAGAIRMSGPNNSVTLGAISSTLVVPADPTMAIETGKKPNIWYSLNGKIRAVNVPKVTKEKPTPPVKPTAPTKPTYETEKPLKPAPVAPNYEKEPTPPTRTPDQAEPNKPTPPTYETEKPLEPAPVEPSYEAEPTPPTRTPDQAEPNKPTPPTYETEKPLEPAPVEPSYEAEPTPPTPTPDQPEPNKPVEPTYEVIPTPPTDPVYQDLPTPPSVPTVHFHYFKLAVQPQVNKEIRNNNDINIDRTLVAKQSVVKFQLKTADLPAGRDETTSFVLVDPLPSGYQFNPEATKAASPGFDVTYDNATNTVTFKATAATLATFNADLTKSVATIYPTVVGQVLNDGATYKNNFTLTVNDAYGIKSNVVRVTTPGKPNDPDNPNNNYIKPTKVNKNENGVVIDGKTVLAGSTNYYELTWDLDQYKNDRSSADTIQKGFYYVDDYPEEALELRQDLVKITDANGNEVTGVSVDNYTNLEAAPQEIRDVLSKAGIRPKGAFQIFRADNPREFYDTYVKTGIDLKIVSPMVVKKQMGQTGGSYENQAYQIDFGNGYASNIIINNVPKINPKKDVTLTLDPADTNNVDGQTIPLNTVFNYRLIGGIIPADHSEELFEYNFYDDYDQTGDHYTGQYKVFAKVDITFKDGSIIKSGAELTQYTTAEVDTAKGAITIKFKEAFLRSVSIDSAFQAESYIQMKRIAVGTFENTYINTVNGVTYSSNTVKTTTPEDPTDPTDPQDPSSPRTSTVINYKPQSTAYQPSSVQETLPNTGVTNNAYMPLLGIIGLVTSFSLLGLKAKKD

SEQ ID NO: 212 - protein, 834 aa, Streptococcus mutans UA159
MLTELKAVLKKPMLWITMVGVALVPALYNIIFLSSMWDPYGKVSDLPVAVVNKDKTATYEGKKMTIGKDMTDNMVRNKSLDYHFVDSEKAQKGLEKGDYYMIITLPEDLSQNAASVLTDEPKKLTIPYQTSKGHSFVASKMSETAAKTLKESVSKNITSSYTKSLFKNMSTLKTGLGSAANASQKIATGSKQLANGSQVMTDNLNLLSNSSQSFAQGTNTLYSGLTAYTGGVGQLSAGLNNLNNGLTAYTNGVGQLANGSSQLSNQSQKLLGGVAQLANGSASIQQLVNASSQLNQGLIKLSTATGLSEEQVQQFSSLINQLGTLNQSIQNYSDNGTATTANSPDLSTYLSAITTAAQAIVNSGNTSQQTTTNQSNALAAVQATGAYQRLSAEDQSEIAAALANTGSSTTTTGADANAVSQAQAILNNVQSIQSALSTLQTTTANTPTSPSASLTQIKNTANSVLPSAATSLTTLSSGLTQAKTALDSQVVPVSTALANGTAQLGSTFSTGANSLMTGVGQYTNAVDILNAGANTLAAKNNQLTDGTSQLVNGANQLNSNSGQLTKGTAQLANGANQIETGAGKLAAGGESLTAGLTTLSSGSGELSKALSTAKNKLSLVAVDNDNAKTLSSPVTIKHTDKDNVKTNGVGMAPYMMSAALMVMAISTNTIFRVALSGKQAKTLREWIDQKLAVNGLIAVTGAIILYFGVHIIGLSANFELKTLGLIILTSITFMVLVTTLVTWHDKFGSFAALILLLLQLGSSAGTYPLAVTDKFFQVVNPYLPMSYSVSGLRETISMAGTIGNQLLALSLFFLTFAALGLLIARRRIRSVKVA

SEQ ID NO: 213 - protein, 692 aa, Streptococcus mutans UA159
MVSQKNKSKKGQSKTFTLISNRINLLFFLIVALFTVLLLRLAQMQLYDAKFYKSKLTESTTYTIKTSSPRGQIYDAKGVALVENEVKEVVAFTRSNTMTAKDIKANAKKLADMVTLTESKVTKRQKKDYYLADPKNYQKIVKKLPNNKKYDNFGNNLTESKIYANAVKAVPNSAIDYSEDEKKIIHIFSQMNATSVFNTASLTTGDLTAEQIAVLATSKSDLKGISVKTDWERKTDKNSITSIIGKVSSQKTGLPAEEANNYVKKGYSLNDRVGTSYLEKQYENDLQGSRTVQAIKVNKEGKIISDKTTAKGTKGKNLKLTLDLEFQKGVEQILNQYFNSELASGNTKYSEGVYAVVLNPNTGAVLSMAGLEHDLKTGEVSSNALGAVTEVFTPGSVVKGATLTAGWENGVLSGNQVLNDQPIQFAGSSPINSWFTNGSTPLTASQSLEYSSNTYMVQLALKLMGQDYHSGMTLSTDGYKEAMEKLRATYAQYGLGVSTGIDLPGESKGYTPEHYDPSNVLTESFGQFDNYTAMQLAQYAAAVANGGKRIAPHLVEGIYDNNKTGGLGNLVQSIDTKVLNNVSISSDDMGIIKEGFYNVVNGGSYATGKTLAKGASVPISAKTGTAEAYVTGDDGKSVYTSNLNVVAYAPSSNPQIAVAVVLPHETDLHGTTSHAITRDIINLYQKMYPMNQ

SEQ ID NO: 214 - protein, 707 aa, Streptococcus mutans UA159
MTVLKYGLGILLSAIILAIIIGGLLFTYYVSSTPKLSEAKLKATNSSLVYDSNNNLIADLGAEKRESISSDSIPMKLVNAVTSIEDHRFFKHRGVDIYRIIGAAWSNLLHKSTQGGSTLDQQLIKLAYFSTKESDQTLKRKAQEVWLSLQMEKKYTKEEILTFYVNKVYMGNGNYGMRTAAKSYYGKDLKDLSIAQLATLAGIPQAPTQYDPYAQPKAATSRRNTVLSQMYKHKKITKREYDAAVATPISDGLQELKRSSSYPKYMDNYLKQVISEVKKRTGQDIFSAGMKVYTNVNADAQQYLWNIYNTDEYIAYPDDNFQVASTVMDVTNGKVIAQLGGRHQDTNVSFGTNQAVLTDRDWGSTMKPISAYGPALESEAFTTTAQMLNDSVYYYPGTTTQVYDWDHRYNGWMTIQTAIQQSRNVPAVRAIDAAGLDTAKGFLSGLGIDYPEMRYSNAISSNTSSSEQKYGASSEKMAAAYAAFSNGGTYYEPQYVNKIEFKDGTSETYDAKGNRAMKETTAYMMTDMLKTVLTYGTGTEAAIPGLYQAGKTGTSNYDDNELVEMSEKLGINPYGLGTIAPDENFVGYTPQYSMAVWTGYKNRLMPVYGDSMKIAAQVYRTMMAYLSSSGNSDWTMPDGLYRSGGYLYLNGSSGSNSRYGAAPATSSSSSSSSSSDSNNNDQNNNQTTEASSDSSSSSSDATTSSNP

SEQ ID NO: 215 - protein, 583 aa, Streptococcus mutans UA159
MKSKTAKITLLSSLALAAFGATNVFADEASTQLNSDTVAAPTADTQASEPAATEKEQSPVVAVVESHTQGNTTTTTSQVTSKELEDAKANANQEGLEVTETEAQKQPSVEAADADNKAQAQTINTAVADYQKAKAEFPQKQEQYNKDFEKYQSDVKEYEAQKAAYEQYKKEVAQGLASGRVEKAQGLVFINEPEAKLSIEGVNQYLTKEARQKHATEDILQQYNTDNYTASDFTQANPYDPKEDTWFKMKVGDQISVTYDNIVNSKYNDKKISKVKINYTLNSSTNNEGSALVNLFHDPTKTIFIGAQTSNAGRNDKISVTMQIIFYDENGNEIDLSGNNAIMSLSSLNHWTTKYGDHVEKVNLGDNEFVKIPGSSVDLHGNEIYSAKDNQYKANGATFNGDGADGWDAVNADGTPRAATAYYGAGAMTYKGEPFTFTVGGNDQNLPTTIWFATNSAVAVPKDPGAKPTPPEKPELKKPTVTWHKNLVVETKTEEVPPVTPPTTPDEPTPEKPKTPEDPQSPVVAKSVSFRTARKGEMRVRERDYQPTLPHAGAAKQNGLATLGAISTAFAAATLIAARKKEN

SEQ ID NO: 216 - protein, 507 aa, Streptococcus mutans UA159
MEQKIFSKRKSKIAGLCGAILTTTVVALASGTVIEADETIEQPVAAETVSQADGDNPEQTTSVQQETAPQQTKTSQSSDATVDSEESATSPSDEQTVSQNDSNSSSQIDQTIADTNRSDSDHISKTSAATTEDQEEKVNSAKAQTAAATNNQDTRYSAKDAYGNSNFNKTLTEFGKNANVADVTYNGVRDEYIVVNDPSAPYVPNANEIAKYLKEYLTELRNINNIAIPVPSVDQVMQKYAQDRANEEANEKNGLDHDTNLPIPNNLTWVAEDGHLDMDSSIQSKSQEGYTLASDKATAYYLALNWFSDYFNIYDDPNDGLKSFGHAVSILSDGGTGMGLGLASGQDNEKGMWYAQLEFGGNDNEDNTNDFSSLKNGKGEWVLYYKGSPVKFLPNTTFWYVKKGTSPDAASTPHNSDKPSFQSSKDLDPNFKADNRFQEGKEASVHQAIPATFKSHRDEVGNKDQNSLSAQLPDTGVQKNNQLALIALGTGLILLSGLLLSKRKSLK

SEQ ID NO: 217 - protein, 726 aa, Streptococcus mutans UA159
MTFEKQKHFSLRKLKFGLVSVAIIAFLFAVTKTAEADETVITEQRQTSKINASSQKVENQTSNQVEAKTDSANKDPQEKTGSVATDAPSMNSANNMSQSDKQNTVNEISSDSQQTKTDEQTDLPQNSFKQQSAHVKMTTEAEKTPSHSINTFVNDGNGNWYYLGADGRNVTGSHTIGGKTMYFAQDGKQVKGAFAQDSDGNKHYYDRDSGEMWTNRFVNDQGNWYYLNNDGVPVTGSITVNGQSLYFNSDGSQVKGNFVEEDGSLRYYDKNSGDLLRKTSRTINGVNYQFDNDGNARAIDKIEVVKTSLVVDSYEFGPSVSKIILEFNHKVTPAVVHAGAMVTTAGVQRKILNSYVSNASGHVVYFDSSHYVTLELDIPYDPNDSSRNASPFIFDSAAFRNNWVNSYTVKVDNLQVQADGSNSSQIISSEQDAINNRFLPTTDRFSERGSYGNFNYAAYQPEAAIGGEKNPLIVWLHGIGEVGTDINIPLLASNVARLTEDPIQSHFTSTGSGGQKGAYVLVPQSSIPWSQNQTASLMALIKAYVASHPDIDSRRIYLAGVSNGGGMTLDMGVAYPNYFAALVPIAASYSNQLTDNQITAAALKALKGQPMWLIHTRTDKTISADSSVLPFYKELLQAGAQNKWLSYYETNVGKHHSGVTYNGHWSWIYFLNDQVTGTQNTDNAKNWSGLSGMVATNPTYGGDAKATVNGRTYSNVFDWLNGQRRR

SEQ ID NO: 218 - protein, 857 aa, Streptococcus mutans UA159
MKIFIKKHQQSILYYSLSFLLPSFIMFLVLFSKNIYWGSSTTILASDGFHQYVIFDALFRNILHGTDSLFYSFKAGLGFNIFALTSYYLGSFLTPFTYFFNVKNMADAFYLFTLIKFGLIGLSAFYSLGQIYTKISKSLVLMLSTSYALMSFTSSQLELNNWLDVFILLPLIMLGLQRLVEKRGIFLYFLTLTCLFIQNYYFGFMTAIFLTLWFFTQVSWDIRNRMKRLSDFVLVSIFATLTSAFMLLPTFLDLKSHGEVLTEQISLFSSDIWYFDFFAKSLLGSYDTTKYGSIPTIYIGLLPLIFAITFFFVKSIKWQVKVAYFLLLAIIIASFIFQPLDLFWQGMHSPNMFLHRYSWAFSLVIVIMAAETLTRIKDIKLKNFYPAFTFLGVGLLATFLFKDYYNYLTQVNFILTTIFLVSYFIILFTFFNQLVSYKVIISFTLIFTSFEIALNTFYQIEGIQTDWNFPSREVYEDNVKEIDNYVKKTKKDNLEFFRTEKQIPQTYNDGMKFNYNSISQFSSVKNNLSAQLLNSLGYYSQGNHSTISYPNNTILMDSLFSIKYNINNQNPHKFGFHLKQKNNKLQLYKNFYSLPLALMSNHIYKDVKFDSYPLDNQQKFVNELTDLNLTLFKEIPIISSVGMQVLDNRVTINGSKGNKAQVYYTVKCPANSQLYISLPNLTVNNKDENVFITTNKHTSSYIIDESYYLFNLGNYKKTQTLIFKLSFPKNKTVSYDLPHIYALDLTAYQKSIKQLKSQTVKTTTKKNKIFTTYVAKKRTSLIYTLPYDKGWFAKQNGKAIKISKAQNGLMKIDVSKGSGKIIMTFVPQGLYQGILLTCLGIFLFVFYQLYYKKFNLK

SEQ ID NO: 219 - protein, 267 aa, Streptococcus mutans UA159
MKLKHILRIGAVAFASILLLTACGSKTSKKTVTLATVGTTNPFSYEKKGKLTGYDIEVAKEVFKASDKYDVKYQKTEWTSIFSGLDSDKYQIGANNISYTKERANKYLYSNPTASNPLVLVVPKDSDIKSYNDIAGHSTQVVQGNTTVSMLQKFNKNHENNQVKLNFTSEDLAHQIRNVSDGKYDFKIFEKISAETIIKEQGLDNLKVIDLPSDQKPYVYFIFAQDQKDLQKFVNKRLKKLYENGTLEKLSKKYLGGSYLPDKKDMK

SEQ ID NO: 220 - protein, 352 aa, Streptococcus mutans UA159
MRFLVFLIAFFAAFYKFIETERIDSNTVAVNPDSLILKRFLKTNQLNGIMIVTGPDGKAQVFSNQSKVDGSPVSIKDYFPLASLQKLITGVAIQQLIDKGKLSLNTPLSKYYPQIENSENITIQNLLTHTSGLADRKEVPQQVLTTQEQQLDFSLTNYRVTYRKKWKYANINYALLAGIISQISGQNYATYVRQHFLTAGKGWHFKKYIQIKDKSKLAALSVMDQSTTWDKLSKEVTSTFGAGDYASRPVDYWKFMMAFINDQFVPVSEYQRSMKMTSKSYYGGLYISQKMLHANGGGFDTYSCFAYSNPKTKQVMVLFITNGKYKRVKSLAAKAFKLYADSYALRKNETSK

SEQ ID NO: 221 - protein, 390 aa, Streptococcus mutans UA159
MKKKIALAALSFVSAAVLAACSSAPGGSSDAAGNKIGDTVKIGYNLELSGDVAAYGQAEKNGANLAVEEINKAGGIDGKKIKVISKDNKSDNGEASTISTNLATQSKVNAILGPATSGATAAAAPNANDAAVPLVTPSGTQDNLTYSKGKVQDYIFRTTFQDSFQGKIIAKYATDNLKAKKVALYYDKSSDYAQGIADAFKKAYKGKITVEDTFQAKDQDFQAALTKFKNKDFDAIVIPGYYTETGLITKQARDMGLTQPILGPDGFNDEKYVEGAGAANTNNVHYVSGYSTKVALTNKAEKFLKDYKAKYGEEPNMFAALAYDSVYMIADAAKDAKTSKDIATNLAKLKNFKGVTGKMTIDKKHNPVKSAVMVGLKDGKEDTATAVEAK

SEQ ID NO: 222 - protein, 306 aa, Streptococcus mutans UA159
MKKLSLLLLVCLSLLGLFACTSKKTADKKLTVVATNSIIADITKNIAGNKVVLHSIVPVGRDPHEYEPLPEDVKKTSQADVIFYNGINLENGGNAWFTKLVKNAHKKTDKDYFAVSDSVKTIYLENAKEKGKEDPHAWLDLKNGIIYAKNIMKRLSEKDPKNKSYYQKNFQAYSAKLEKLHKVAKEKISRIPTEKKMIVTSEGCFKYFSKAYDIPSAYIWEINTEEEGTPNQIKALVKKLRKSRVSALFVESSVDDRPMKTVSKDTGIPIAAKIFTDSVAKKGQAGDSYYAMMKWNIDKIANGLSQ

SEQ ID NO: 223 - protein, 365 aa, Streptococcus mutans UA159
MFVHTKTKKKRKWQRKVFLLLLLFLLPIVSVLAFIVLFIGGGTAESHDVEATTGGVKLSAKQFADKTKLGISEEEAKNALAFADRLMSRHHFTAQATAGVLAVGFRESGFDVKAVNNSGGVAGFFQWSGWGSSVNGDRWKVASKRELTLEVEVDLMSTELDGRYADVVKKVGSATDEKQAAKDWSQYYEGVAVSDGQTKADKIESWATTICEALKSGGTNYAKVNNTGTSSTAIPQGWENISAFDGHAYEGSENYPQGQCTWYVYNRAKQLGVSFSPYMGNGGQWYQVQGYHSSHTPKAHTALSFVNGQAGSDPTYGHVAFVEAVKDDGSILISEMNVYGQPAMTVAYRTFDAETAKQFWYVEGK

SEQ ID NO: 224 - protein, 453 aa, Streptococcus mutans UA159
MKMKRKLLSLVSVLTILLGAFWVTKIVKADQVTNYTNTASITKSDGTALSNDPSKAVNYWEPLSFSNSITFPDEVSIKAGDTLTIKLPEQLQFTTALTFDVMHTNGQLAGKATTDPNTGEVTVTFTDIFEKLPNDKAMTLNFNAQLNHNNISIPGVVNFNYNNVAYSSYVKDKDITPISPDVNKVGYQDKSNPGLIHWKVLINNKQGAIDNLTLTDVVGEDQEIVKDSLVAARLQYIAGDDVDSLDEAASRPYAEDFSKNVTYQTNDLGLTTGFTYTIPGSSNNAIFISYTTRLTSSQSAGKDVSNTIAISGNNINYSNQTGYARIESAYGRASSRVKRQAETTTVTETTTSSSSETTTSEATTETSSTTNNNSTTTETATSTTGASTTQTKTTASQTNVPTTTNITTTSKQVTKQKAKFVLPSTGEQAGLLLTTVGLVIVAVAGVYFYRTRR

SEQ ID NO: 225 - protein, 271 aa, Streptococcus mutans UA159
MTFKKLVLGLLSFVAVFTLVACSSSNSKNLQDDIKEKKKLVVAVSPDYAPFEFKALVNGKDTVVGADIDLAKAIAKELGVKLELSSMSFDNVLSSLKTGKADIAISGLSYTKERAQAYDFSEAYYKTENAILIKKSDLNKYTMISSFNNKTKVAVQKGTIEEGLAKNQLKQSNITSLTSMGEAVNELKSGQVDAIDLEKPVAEGYVSQNSDLVLAKVALKTGEGDAKAVALPKDSGQLVKTVNKVIKKLKKEDKYKQFISDAVKLTGQQVD

SEQ ID NO: 226 - protein, 283 aa, Streptococcus mutans UA159
MKKHFFMTFSLLLAAVFLVACSNLSDSGQRNWDKINKRGMLKIATAGTLYPQSYHDDHNKLTGYDVEILKEIGKRLGLKVQFTEMGVDGMLTAIKSGQIDVANYSLEDGNKNISKFLRTSPYKYSFTSMVVRSKDDSGIHSWSDLKGKKAAGAASTNYMKIAKKLGAKLVVYDNVTNDVYMKDLVNGRTDVIINDYYLQKIAVAAVKDKYAIKINQGLYANPYSTSFTLSLKNKVLQKKINKAVKDMRKDGTLTKLSKKFFQGEDVTKKHYNSYKKIDISDVD

SEQ ID NO: 227 - protein, 294 aa, Streptococcus pneumoniae R6
MKLLKKMMQVALATFFFGLLGTSTVFADDSEGWQFVQENGRTYYKKGALKETYWRVIDGKYYYFDPLSGEMVVGWQYIPAPHKGVTIGPSPRIEIALRPDWFYFGQDGVLQEFVGKQVLEAKTATNTNKHHGEEYDSQAEKRVYYFEDQRSYHTLKTGWIYEEGYWYYLQKDGGFDSRINRLTVGELARGWVKDYPLTYDEEKLKAAPWYYLDPATGWQNLGNKWYYLRSSGAMATGWYQEGSTWYYLNASNGDMKTGWFQVNGNWYYAYDSGALAVNTTVGGYYLNYNGEWVK

SEQ ID NO: 228 - protein, 338 aa, Streptococcus pneumoniae R6
MKLLKKMMQVLLAVFFFGLLATNTVFANTTGGRFVDKDNRKYYVKDDHKAIYWHKIDGKTYYFGDIGEMVVGWQYLEIPGTGYRDNLFDNQPVNEIGLQEKWYYFGQDGALLEQTDKQVLEAKTSENTGKVYGEQYPLSAEKRTYYFDNNYAVKTGWIYEDGNWYYLNKLGNFGDDSYNPLPIGEVAKGWTQDFHVTIDIDRSKPAPWYYLDASGKMLTDWQKVNGKWYYFGSSGSMATGWKYVRGKWYYLDNKNGDMKTGWQYLGNKWYYLRSSGAMVTGWYQDGLTWYYLNAGNGDMKTGWFQVNGKWYYAYSSGALAVNTTVDGYSVNYNGEWVQ

SEQ ID NO: 229 - protein, 619 aa, Streptococcus pneumoniae R6
MNKKKMILTSLASVAILGAGFVASQPTVVRAEESPVASQSKAEKDYDAAKKDAKNAKKAVEDAQKALDDAKAAQKKYDEDQKKTEEKAALEKAASEEMDKAVAAVQQAYLAYQQATDKAAKDAADKMIDEAKKREEEAKTKFNTVRAMVVPEPEQLAETKKKSEEAKQKAPELTKKLEEAKAKLEEAEKKATEAKQKVDAEEVAPQAKIAELENQVHRLEQELKEIDESESEDYAKEGFRAPLQSKLDAKKAKLSKLEELSDKIDELDAEIAKLEDQLKAAEENNNVEDYFKEGLEKTIAAKKAELEKTEADLKKAVNEPEKPAPAPETPAPEAPAEQPKPAPAPQPAPAPKPEKPAEQPKPEKTDDQQAEEDYARRSEEEYNRLTQQQPPKAEKPAPAPKTGWKQENGMWYFYNTDGSMATGWLQNNGSWYYLNSNGAMATGWLQYNGSWYYLNANGAMATGWAKVNGSWYYLNANGAMATGWLQYNGSWYYLNANGAMATGWAKVNGSWYYLNANGAMATGWLQYNGSWYYLNANGAMATGWAKVNGSWYYLNANGAMATGWVKDGDTWYYLEASGAMKASQWFKVSDKWYYVNGLGALAVNTTVDGYKVNANGEWV

SEQ ID NO: 230 - protein, 448 aa, Streptococcus pneumoniae R6
MKILPFIARGTSYYLKMSVKKLVPFLVVGLMLAAGDSVYAYSRGNGSIARGDDYPAYYKNGSQEIDQWRMYSRQCTSFVAFRLSNVNGFEIPAAYGNANEWGHRARREGYRVDNTPTIGSITWSTAGTYGHVAWVSNVMGDQIEIEEYNYGYTESYNKRVIKANTMTGFIHFKDLDSGSVGNSQSSASTGGTHYFKTKSAIKTEPLVSATVIDYYYPGEKVHYDQILEKDGYKWLSYTAYNGSYRYVQLEAVNKNPLGNSVLSSTGGTHYFKIKSAIKTEPLVSATVIDYYYPGEKVHYDQILEKDGYKWLSYTAYNGSRRYIQLEGVTSSQNYQNQSGNISSYGSNNSSTVGWKKINGSWYHFKSNGSKSTGWLKDGSSWYYLKLSGEMQTGWLKENGSWYYLGSSGAMKTGWYQVSGEWYYSYSSGALAINTTVDGYRVNSDGERV

SEQ ID NO: 231 - protein, 701 aa, Streptococcus pneumoniae R6
MFASKSERKVHYSIRKFSIGVASVAVASLVMGSVVHATENEGSTQAATSSNMAKTEHRKAAKQVVDEYIEKMLREIQLDRRKHTQNVALNIKLSAIKTKYLRELNVLEEKSKDELPSEIKAKLDAAFEKFKKDTLKPGEKVAEAKKKVEEAKKKAEDQKEEDRRNYPTNTYKTLELEIAEFDVKVKEAELELVKEEAKESRNEGTIKQAKEKVESKKAEATRLENIKTDRKKAEEEAKRKADAKLKEANVATSDQGKPKGRAKRGVPGELATPDKKENDAKSSDSSVGEETLPSSSLKSGKKVAEAEKKVEEAEKKAKDQKEEDRRNYPTNTYKTLDLEIAESDVKVKEAELELVKEEAKEPRDEEKIKQAKAKVESKKAEATRLENIKTDRKKAEEEAKRKAAEEDKVKEKPAEQPQPAPATQPEKPAPKPEKPAEQPKAEKTDDQQAEEDYARRSEEEYNRLTQQQPPKTEKPAQPSTPKTGWKQENGMWYFYNTDGSMATGWLQNNGSWYYLNANGAMATGWLQNNGSWYYLNANGSMATGWLQNNGSWYYLNANGAMATGWLQYNGSWYYLNSNGAMATGWLQYNGSWYYLNANGDMATGWLQNNGSWYYLNANGDMATGWLQYNGSWYYLNANGDMATGWVKDGDTWYYLEASGAMKASQWFKVSDKWYYVNGSGALAVNTTVDGYGVNANGEWVN

SEQ ID NO: 232 - protein, 690 aa, Streptococcus pneumoniae R6
MKKTTILSLTTAAVILAAYVPNEPILAAYVPNEPILADTPSSEVIKETKVGSIIQQNNIKYKVLTVEGNIGTVQVGNGVTPVEFEAGQDGKPFTIPTKITVGDKVFTVTEVASQAFSYYPDETGRIVYYPSSITIPSSIKKIQKKGFHGSKAKTIIFDKGSQLEKIEDRAFDFSELEEIELPASLEYIGTSAFSFSQKLKKLTFSSSSKLELISHEAFANLSNLEKLTLPKSVKTLGSNLFRLTTSLKHVDVEEGNESFASVDGVLFSKDKTQLIYYPSQKNDESYKTPKETKELASYSFNKNSYLKKLELNEGLEKIGTFAFADAIKLEEISLPNSLETIERLAFYGNLELKELILPDNVKNFGKHVMNGLPKFLTLSGNNINSLPSFFLSGVLDSLKEIHIKNKSTEFSVKKDTFAIPETVKFYVTSEHIKDVLKSNLSTSNDIIVEKVDNIKQETDVAKPKKNSNQGVVGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKVSGKWYYTYNSGDLLVNTTTPDGYRVNANGEWVG

SEQ ID NO: 233 - protein, 318 aa, Streptococcus pneumoniae R6
MEINVSKLRTDLPQVGVQPYRQVHAHSTGNPHSTVQNEADYHWRKDPELGFFSHIVGNGCIMQVGPVDNGAWDVGGGWNAETYAAVELIESHSTKEEFMTDYRLYIELLRNLADEAGLPKTLDTGSLAGIKTHEYCTNNQPNNHSDHVDPYPYLAKWGISREQFKHDIENGLTIETGWQKNDTGYWYVHSDGSYPKDKFEKINGTWYYFDSSGYMLADRWRKHTDGNWYWFDNSGEMATGWKKIADKWYYFNEEGAMKTGWVKYKDTWYYLDAKEGAMVSNAFIQSADGTGWYYLKPDGTLADRPEFTVEPDGLITVK

SEQ ID NO: 234 - protein, 127 aa, Neisseria meningitidis Z2491
MTFAYWCILIAYLLPLFCAAYAKKAGGFRFKDNHNPRDFLARTQGTAARAHAAQQNGFEAFAPFAAAVLTAHATGNAGQATVNTLAGLFILFRLAFIWCYIADKAALRSLMWVGGFVCTVGLFVVAA

SEQ ID NO: 235 - protein, 592 aa, Neisseria meningitidis Z2491
MNKIYRIIWNSALNAWVAVSELTRNHTKRASATVKTAVLATLLFATVQANATDEDEEEELESVQRSVVGSIQASMEGSGELETISLSMTNDSKEFVDPYIVVTLKAGDNLKIKQNTNENTNASSFTYSLKKDLTGLINVETEKLSFGANGKKVNIISDTKGLNFAKETAGTNGDTTVHLNGIGSTLTDTLAGSSASHVDAGNQSTHYTRAASIKDVLNAGWNIKGVKTGSTTGQSENVDFVRTYDTVEFLSADTKTTTVNVESKDNGKRTEVKIGAKTSVIKEKDGKLVTGKGKGENGSSTDEGEGLVTAKEVIDAVNKAGWRMKTTTANGQTGQADKFETVTSGTNVTFASGKGTTATVSKDDQGNITVMYDVNVGDALNVNQLQNSGWNLDSKAVAGSSGKVISGNVSPSKGKMDETVNINAGNNIEISRNGKNIDIATSMAPQFSSVSLGAGADAPTLSVDDEGALNVGSKDANKPVRITNVAPGVKEGDVTNVAQLKGVAQNLNNRIDNVDGNARAGIAQAIATAGLVQAYLPGKSMMAIGGGTYRGEAGYAIGYSSISDGGNWIIKGTASGNSRGHFGASASVGYQW

SEQ ID NO: 236 - protein, 141 aa, Neisseria meningitidis Z2491
MLLAEGQKSAVTEYYLNHGTWPSNNSDAGVASTATDIKGKYVKEVKVEKGVITATMLSSGVNNEIKGKKLSLWAKRQAGSVKWFCGQPVERAANNAANDAVTAATANGNGKIDTKHLPSTCRDAASAVCIETPPTAFYKNT

SEQ ID NO: 237 - protein, 1449 aa, Neisseria meningitidis Z2491
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFSYQIVKRNNYKPDNSHPYNGDYHMPRLHKFVTDAEPVEMTSDMRGNTYSDKEKYPERVRIGSGHHYWRYDDDKHGDLSYSGAWLIGGNTHMQGWGNNGVVSLSGDVRHANDYGPMPIAGAAGDSGSPMFIYDKTNNKWLLNGVLQTGYPYSGRENGFQLIRKDWFYDDIYRGDTHTVFFEPRSNGHFSFTSNNNGTGTVTETNEKVSNPKLKVQTVRLFDESLNETDKEPVYAAGGVNQYRPRLNNGENLSFIDYGNGKLILSNNINQGAGGLYFEGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNATTTSTVTITGNESITQPSGKNINRLNYSKEIAYNGWFGEKDTTKTNGRLNLVYQPAAEDRTLLLSGGTNLNGNITQTNGKLFFSGRPTPHAYNHLGSGWSKMEGIPQGEIVWDNDWINRTFKAENFHIQGGQAVISRNVAKVEGDWHLSNHAQAVFGVAPHQSHTICTRSDWTGLTNCVEKTITDDKVIASLTKTDISGNVSLADHAHLNLTGLATLNGNLSANGDTRYTVSHNATQNGNLSLVGNAQATFNQATLNGNTSASGNASFNLSNNAAQNGSLTLSDNAKANVSHSALNGNVSLADKAVFHFENSRFTGQLSGSKDTALHLKDSEWTLPSGTELGNLNLDNATITLNSAYRHDAAGAQTGSVSDTPRRRSRRSLLSVTPPTSVESRFNTLTVNGKLNGQGTFRFMSELFGYRSDKLKLAESSEGTYTLAVNNTGNEPVSLDQLTVVEGKDNKPLSENLNFTLQNEHVDAGAWRYQLIRKDGEFRLHNPVKEQELSDKLGKAEAKKQAEKDNAQSLDALIAAGRDAAEKTESVAEPARQAGGENVGIMQAEEEKKRVQADKDSALAKQREAETRPATTAFPRARRARRDLPQPQPQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIGRFDIGISTGAGFSSGSLSDGIGGKIRRRVLHYGIQARYRAGFGGFGIEPYIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 238 - protein, 170 aa, Neisseria meningitidis Z2491
MNTLQKGFTLIELMIVIAIVGILAAVALPAYQDYTARAQVSEAILLAEGQKSAVTEYYLNHGEWPSNNTSAGVASSTDIKGKYVQSVEVKNGVVTATMASSNVNNEIKGKKLSLWAKRQDGSVKWFCGQPVKRNDTATTNDDVKADTAANGKQIDTKHLPSTCRDAASAG

SEQ ID NO: 239 - protein, 320 aa, Neisseria meningitidis Z2491
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHMGNSAPSVEADNSHEGYGYSDEAVRRHRQGQP

SEQ ID NO: 240 - protein, 140 aa, Neisseria meningitidis Z2491
MRPIFLSFVLFPILITACSTPDKSARWENIGTISNGNIHTYINKDSVRKNGNLMIFQDKKVVTNLKQERFANTPAYKTAIAEWEIHCNNKTYRLSSLQLFDTKNTEISTQNYTASSLRPMSILSGTLTEKQYETVCGKKL

SEQ ID NO: 241 - protein, 84 aa, Neisseria meningitidis Z2491
MNKLFITALSALALSACAGTWEGAKQDTARNLDKTQAAAERAAEQTGNAVEKGWDKTKEAVKKGGNAVGRGISHLGGKIENATE

SEQ ID NO: 242 - protein, 123 aa, Neisseria meningitidis Z2491
MKLLFIPLVLFVAVEHFYIAWLEMTQIPSEKAAETFKLPYEFMEQNRVQTLFGNQGLYNGFLGIGLVWSRFAAPDNAVYGATVLFLGFVLIAAAWGAFSSGNKGILVKQGLPAFLAAAAVLAV

SEQ ID NO: 243 - protein, 120 aa, Neisseria meningitidis Z2491
MASSNVNNEIKDKKLSLWAKRQDGSVKWFCGQPVKRDAATDADVTADSGNEIDTKHLPSTCRDAASAVCTKTPEYYPNHGEWPKNFVIPAQAGIQVCRHGNLSGKKVSPVLSSRFPLSWE

SEQ ID NO: 244 - protein, 128 aa, Neisseria meningitidis Z2491
MLLAEGQKSAVTEYYLNHGEWPSNNTSAGVATSTDIKGKYVQSVEVKNGVVTATMASSNVNNEIKGKKLSLWAKRQDGSVKWFCGQPVKRNDTATTNDDVKADTAANGKQIDTKHLPSTASTRKSTPN

SEQ ID NO: 245 - protein, 810 aa, Neisseria meningitidis Z2491
MPIPFKPVLAAAAIAQAFPAFAADPAPQSAQTLNEITVTGTHKTQKLGEEKIRRKTLDKLLVNDEHDLVRYDPGISVVEGGRAGSNGFTIRGVDKDRVAINVDGLAQAESRSSEAFQELFGAYGNFNANRNTSEPENFSEVTITKGADSLKSGSGALGGAVNYQTKSASDYVSEDKPYHLGIKGGSVGKNSQKFSSITAAGRLFGLDALLVYTRRFGKETKNRSTEGDIEIKNDGYVYNPTDTGGPSKYLTYVATGVARSQPDPQEWVNKSTLFKLGYNFNDQNRIGWIFEDSRTDRFTNELSNLWTGTTTSAATGDYRHRQDVSYRRRSGVEYKNELEHGPWDSLKLRYDKQRIDMNTWTWDIPKNYDKRGINGEVYHSFRHIRQNTAQWTADFEKQLDFSKAVWAAQYGLGGGKGDNANSDYSYFAKLYDPKILASNQAKITMLIENRSKYKFAYWNNAFHLGGNDRFRLNAGIRYDKNSSSAKDDPKYTTAIRGQIPHLGSERAHAGFSYGTGFDWRFTKHLHLLAKYSTGFRAPTSDETWLLFPHPDFYLKANPNLKAEKAKNWELGLAGSGKAGNFKLSGFKTKYRDFIELTYMGVSSDDKNNPRYAPLSDGTALVSSPVWQNQNRSAAWVKGIEFNGTWNLDSIGLPKGLHTGLNVSYIKGKATQNNGKETPINALSPWTAVYSLGYDAPSKRWGINAYATRTAAKKPSDTVHSNDDLNNPWPYAKHSKAYTLFDLSAYLNIGKQVTLRAAAYNITNKQYYTWESLRSIREFGTVNRVDNKTHAGIQRFTSPGRSYNFTIEAKF

SEQ ID NO: 246 - protein, 329 aa, Neisseria meningitidis Z2491
MKKSLIALTLAALPVAAMADVTLYGTIKTGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNVGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKGENKFVATAGGVGLRHKF

SEQ ID NO: 247 - protein, 313 aa, Neisseria meningitidis Z2491
MKTLLLLIPLVLTACGTLTGIPAHGGGKRFAVEQELVAASSRAAVKEMDLSALKGRKAALYVSVMGDQGSGNISGGRYSIDALIRGGYHNNPESATQYSYPAYDTTATTKSDALSSVTTSTSLLNAPAAALTKNSGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLIAPKTAAYESQYQEQYALWMGPYSVGKTVKASDRLMVDFSDITPYGDTTAQNRPDFKQNNGKKPDVGNEVIRRRKGG

SEQ ID NO: 248 - protein, 123 aa, Neisseria meningitidis Z2491
MNKTLSILPVAILLGGCAAGGGNTFGSLDGGTGMGGSIVKMAVESQCRAELNKRSEWRLTALAMSAEKQAEWENKICACVAQEAPNQLTGNDVMQMLDPSTRNQALAALTAKTVSACFKHLYR

SEQ ID NO: 249 - protein, 186 aa, Neisseria meningitidis Z2491
MNPLIHQAKESSMQTRILSAVLLAFSTAAFAGGAFTLQFDNPSEDGGFTQNQILSAPYGFGCSGGNASPALSWKNPPAGTKSFVLTVYDKDAPTGLGWMHWVVADIPADVRRRNATSLQLSRCASIADDQSAAISAVISLQICRIRLTPSYTAKPMPSCCNHANTPQSAASAALCGTSSSVSTAAA

SEQ ID NO: 250 - protein, 1037 aa, Neisseria meningitidis Z2491
MNKTLKRRVFRHTALYAAILMFSHTGGGGGAMAQTRQYAIIMNERNQPEVQWNGSYSIKDKDRKREYTHHNHQQGGSSVSFNNSDELVSRQSGTAVFGTATYLPPYGKVSGFDAAALKERNNAVDWIHTTHPGLIGYSYDGVVCRSATDCPKLVYKTRFSFDNPDLAKTGGGLDKHTEPSRDNSPIYKLKDHPWLGVSFNLGAEGIAKNGKTINKLVSSFNEKNSNNNLVYTTEGRDISLGNWQRETTAMAYYLNAKLHLLDKKQIQNITDKTVQLGVLKPSIDVRTRNTGTAGILSYWAKWDIKDTGQIPVKLSLTQVKAGRCVNKDNPNKNTKTSSPALTAPALWFGAGQDGKAEMYSASVSTYPDSSSSRIFLQNLKRKTDTSRPGRYSLATLNKSDIESREPSFTSRQTVIRLDGGVQQIKLDRNNTEVTGFNGNDGKNDTFGIVSEGSFMPDASEWKKVLLPWTVRAFNYDGRFNTVNKEENNGKPKYSQKYRSRNNGKHERNLGDIVNSPIVAVGEYLATSANDGMVHIFKQSGGDKRSYNLKLSYIPGTMPRKDIESKDSTLAKELRAFAEKGYVGDRYGVDGGFVLRRITDDQDKQKHFFMFGAMGLGGRGAYALDLTKADDNDPTKASLFDVKDNGNNGNNGNNRVELGYTVGTPQIGKTHNGKYAAFLASGYATKQIDSGENKTALYVYDLESNNGTLIRKIEVTDGKGGLSSPTLVDKDLDGTVDIAYAGDRGGKMYRFDLSGNNPNSWTVRTIFQGTKPITSAPAISQLKDKRVVIFGTGSDLSEDDVLSTDEQHIYGIFDNDTNTGTAQEGLGKGLLEQKLSEENKTLFLTDYKRSDGSGDKGWVVKLKDGQRVTVKPTVVLRTAFVTIHKYTGNDKCGAETAILGINTADGGKLTKKSARPIVPAANSKVAQYSGDKKTSSGKSIPIGCMEKDGGTVCPNGYVYDKPVNVRYLDEKKTDGFSTTADGDAGGSGTFKEGKKPARNNRCFSGKGVRTLLMNDLDSLDITGPMCGMKRISWREVFY

SEQ ID NO: 251 - protein, 308 aa, Neisseria meningitidis Z2491
MKHPKLTLIAALLTTAATAAPLPVVTSFSILGDVAKQIGGERVSIQSLVGANQDTHAYHMTSGDIKKIRSAKLVLINGLGLEAADIQRAVKQSKVSYAEATKGIQPLKAEEEGGHHHDHDHDHDHDHEGHHHDHGEYDPHVWNDPVLMSAYAQNVAEALIKADPEGKVYYQQRLGNYQMQLKKLHSDAQAAFNAVPAAKRKVLTGHDAFSYMGKRYHIEFIAPQGVSSEAEPSAKQVAAIIRQIKREGIKAVFTENIKDTRMVDRIAKETGVNVSGKLYSDALGNAPADTYIGMYRHNIKALTNAMKQ

SEQ ID NO: 252 - protein, 398 aa, Streptococcus pyogenes MGAS8232
MKKRILSAVLVSGVTLGAATTVGAEDLSTKIAKQDSIISNLTTEQKAAQNQVSALQAQVSSLQSEQDKLTARNTELEALSKRFEQEIKALTSQIVARNEKLKNQARSAYKNNETSGYINALLNSKSISDVVNRLVAINRAVSANAKLLEQQKADKVSLEEKQAANQTAINTIAANMAMAEENQNTLRTQQANLEAATANLALQLASATEDKANLVAQKEAAEKAAAEALAQEQAAKVKAQEQAAQQAASVEAAKSAITPAPQATPAAQSSNAIEPAALTAPAAPSARPQTSYDSSNTYPVGQCTWGAKSLAPWAGNNWGNGGQWAYSAQAAGYRTGSTPMVGAIAVWNDGGYGHVAVVVEVQSASSIRVMESNYSGRQYIADHRGWFNPTGVTFIYPH

SEQ ID NO: 253 - protein, 721 aa, Streptococcus pyogenes MGAS8232
MITIKNPKILKWLKYVLSAILSLIILVIIIGGLLFTFYISSAPKLSEAQLKSTNSSLVYDGNNNLIADLGSEKRENVTADSIPINLVNAITSIEDKRFFNHRGVDLYRIFGAAFHNLTSQTTQGGSTLDQQLIKLAYFSTNESDQTLKRKAQEVWLALQMERKYTKQEILTFYINKVYMGNGNYGMLTAAKSYYGKDLKDLSYAQLALLAGIPQAPSQYDPYLHPEAAQNRRNVVLQQMYMEKHLTKAEYETAIATPVAEGLQSLQQRSTYPKYMDNYLKQVIEEVKKETNKDIFTAGLKVYTNIIPDAQQTLYNIYHSGDYVYYPDQDFQVASTIVDVTNGHVIAQLGGRNQDENVSFGTNQAVLTDRDWGSTMKPITAYAPAIESGVYTSTAQSTNDSVYYWPGTTTQLFNWDLRYNGWMTIQAAIMLSRNVPAVRALEAAGLDYARSFLSSLGINYPEMHYSNAISSNNSSSDKKYGASSEKMAAAYAAFANGGIYHKPRYVNKVEFSDGTSKTFDEKGKRAMKETTAYMMTDMLKTVLTYGTGTAAAIPGVAQAGKTGTSNYTDEELAKIGEKYGLYPDYVGTLAPDENFVGFTKRYAMAVWTGYKNRLTPVYGSSLEIASDVYRSMMTYLTNGYSEDWTMPNGLYRSGGFLYLSGTYASNTDYTNSVYNNLYSNNTTTASSQTTSDDTSSSNDTSNSTNTDNNGSHPSTDDKKTTH

SEQ ID NO: 254 - protein, 393 aa, Streptococcus pyogenes MGAS8232
MIITKKSLFVTSVALSLAPLVTAQAQEWTPRSVTEIKSELVLVDNVFTYTVKYGDTLSTIAEAMGIDVHVLGDINHIANIDLIFPDTILTANYNQHGQATTLTVQAPASSPASVSHVPSSEPLPQASATSQSTVPMAPSATPSDVPTTPLASAKPDSFVTASSELTSSTNDVSTELSSESQKQPEVSQEAVPTPKAAETTEVEPKTDISEDPTSANRPVPNESASEEASSAAPAQAPAEKEETSQMLTAPAAQKAVADTTSVATSNGLSYAPNHAYNPMNAGLQPQTAAFKEEVASAFGITSFSGYRPGDPGDHGKGLAIDFMVPVSSTLGDQVAQYAIDHMAERGISYVIWKQRFYAPFASIYGPAYTWNPMPDRGSITENHYDHVHVSFNA

SEQ ID NO: 255 - protein, 515 aa, Streptococcus pyogenes MGAS8232
MKKKILLMMSLISVFFAWQLTQAKQVLAEGKVKVVTTFYPVYEFTKGVIGNDGDVSMLMKAGTEPHDFEPSTKDIKKIQDADAFVYMDDNMETWVSDVKKSLTSKKVTIVKGTGNMLLVAGAGHDHHHEDADKKHEHNKHSEEGHNHAFDPHVWLSPYRSITVVENIRDSLSKAYPEKAENFKANAATYIEKLKELDKDYTAALSDAKQKSFVTQHAAFGYMALDYGLNQISINGVTPDAEPSAKRIATLSKYVKKYGIKYIYFEENASSKVAKTLAKEAGVKAAVLSPLEGLTKKEMKAGQDYFTVMRKNLETLRLTTDVAGKEILPEKDTTKTVYNGYFKDKEVKDRQLSDWSGSWQSVYPYLQDGTLDQVWDYKAKKSKGKMTAAEYKDYYTTGYKTDVEQIKINGKKKTMTFVRNGEKKTFTYTYAGKEILTYPKGNRGVRFMFEAKEPNAGEFKYVQFSDHAIAPEKAEHFHLYWGGDSQEKLHKELEHWPTYYGSDLSGREIAQEINAH

SEQ ID NO: 256 - protein, 374 aa, Streptococcus pyogenes MGAS8232
MKKFHRFLVSGVILLGFNGLVPTMPSTLISQQENLVHAAVLGDNYPSKWKKGNGIDSWNMYIRQCTSFAAFRLSSANGFQLPKGYGNACTWGHIAKNQGYPVNKTPSIGAIAWFDKNAYQSNAAYDHVAWVADIRGDTVTIEEYNYNAGQGPERYHKRQIPKSQVSGYIHFKDLSSQTSHSYPRQLKHISQASFDPSGTYHFTTRLPVKGQTSIDSPDLAYYEAGQSVYYDKVVTAGGYTWLSYLSFSGNRRYIPIKEPAQSVVQNDNTKPSIKVGDTVTFPGVFRVDQLVNNLIVNKELAGGDPTPLNWIDPTPLDETDNQGKVLGNQILRVGEYFTVTGSYKVLKIDQPSNGIYVQIGSRGTWVNADKANKL

SEQ ID NO: 257 - protein, 53 aa, Streptococcus pyogenes MGAS8232
MLKFTSNILATSVAETTQVAPGGCCCCCTTCCFSIATGSGNSQGGSGSYTPGK

SEQ ID NO: 258 - protein, 495 aa, Streptococcus pyogenes MGAS8232
MGESYSVEAVLTAVDKTFGKTLQSAIRSIEGLEKRSTGFSSVSQKASSMFKSMLGANLAGQAISAMTRTVSSGLGSMLGEMNSSAKAWKTFDANLADIGFGKKQILAVKTAMQDYATKTIYSASDMASTYAQLAAVGVKDTGKLVKAFGGLAASAENPKQAMKSISQQMTQAVGRPTVAWQDFRIMLEQTPAGMAKVAKSMGKNLDELVADIQAGRVKTSDFLEAVKKAGNDKSFQKMATEFKTVDQAIDGMREGLSNKLQPAFEKVNQFGIRAIEAIGKQLDKVDFSKFASNLGKFLEGINIDKIVSNISSAVSSVTSKVKEFWDGFKQTGAISAFSGALQSVWGALKNVASAMSGGNWKTFGATVGGIVKHVSNFAKAVSDVLGKMDPGRLRSWIATFAAVAGGFKLFEKLTGQSVIGSFLDKIGSKFGLFGNKAKEGTDKASNGARRSGGIISQIFSGLGNIVKSAGTAISTAAKGIGVGIKTALSGIPPYH

SEQ ID NO: 259 - protein, 306 aa, Streptococcus pyogenes MGAS8232
MKKGFFLMVMVVSLVMIAGCDKSANPKQPTQGMSVVTSFYPMYAMTKEVSGDLNDVRMIQSGAGIHSFEPSVNDVAAIYDADLFVYHSHTLEAWARDLDPNLKKSKVDVFEASKPLTLDRVKGLEDMEVTQGIDPATLYDPHTWTDPVLAGEEAVNIAKELGRLDPKHKDSYTKNAKAFKKEAEQLTEEYTQKFKKVRSKTFVTQHTAFSYLAKRFGLKQLGISGISPEQEPSPRQLKEIQDFVKEYNVKTIFAEDNVNPKIAHAIAKSTGAKVKTLSPLEAAPSGNKTYLENLRANLEVLYQQLK

SEQ ID NO: 260 - protein, 1647 aa, Streptococcus pyogenes MGAS8232
MEKKQRFSLRKYKSGTFSVLIGSVFLMMTTTVAADELSTMSEPTITNHTQQQAQHLTNTELSSAESKSQDTSQITPKTNREKEQPQGLVSEPTTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLAINPDYGLVGSPSTGRTPTSVAAINSKWVIQRLMTVKELENRADLNHGKAIYSESVDFKNIKDSLGYDKSHQFAYVKESTDAGYKAQDVKDKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMSNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKMYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTAFATPTKTTTSATAKALPSAGEKMGLKLRIVGLVLLGLTCVFSRKKSTKD

SEQ ID NO: 261 - protein, 463 aa, Treponema pallidum subsp. pallidum str. Nichols
MMRSLFSGVSGMQNHQTRMDVIGNNVANVNTTGFKRGRVNFQDLISQQLSAAARPNEEVGGVNPKEVGLGVLIASIDTVHTQGALQTTGINTDVSIQGSGFFVLKSGEKTFFTRAGAFGVDNAGTLVNPANGMRVQGWMAQDVAGERLINSSAQTQDLVIPIGQKIDAQQTSTVHYACNLDKRLPELAADANEADVRKSTWTTDFQVYDSFGQQHTLQINFSRVPGTNNQWQATVAVDPGTEVDTQTRVGVGTSDGAANTFIVNFDNFGHLASVTDTAGNVTGPTGQVLLEASYDVVGANPDDAGQVTRHAFTLNLGEIGTARNTITQFAERSTTKAYRQDGYAMGYLENFKIDQSGVITGVYSNGVSQDIGQLALAGFANQGGLEKAGENTYVQSNNSGIANISTSGVMGKGKLIAGTLEMSNVDLTDQFTDMIITQKGFQAGAKTIQTSDTMLDTVLSLKR

SEQ ID NO: 262 - protein, 758 aa, Treponema pallidum subsp. pallidum str. Nichols
MGCMRWGSVLCVVVGVGASGGVLGQEFSPKLTGSATLEWGISYGKGVGSHGQAPGAVMGTGPYNLKHGFRTTNTVGVSFPLVMRTTHTRRGQHPALYAELKVADLQADLSQGKAGFAVKRKGKVEATLHCYGAYLTIGKNPTFLTNFARLWKPWVTAQYQEDAVQYAPGFGGLGGKVGYRAQDIGGSGVSLDVGFLSFASNGAWDSTDPTHSKYGFGADLKLMYARAGHPLCTVELASNVTLEDGYLIGAQKDANNQNKDKLLWNVGGRLTLEPGAGFRFSFALDAGNQHQSAQDFQNRTQRAQSELTALSNNLFQGESQKQEAWVTQVVQQATQTVTAGVRSALESRGTTYINALEAVQPNPAKPTGKVVQNLHTPQGSPPNLPPLPALPAFSLMGQVLLQYDAEQVVKGFEQVQTQIVTEINQKVQAAVAKNNANMQAVGGSLGDTARMVGEALIKQQLSRKQNSILTMVSVQDEVKQDLADLVPMMRTEITAFFASVQQHITEEVKKKTDALNAGQQIRQAIQNLRASAWRAFLMGVSAVCLYLDTYNVAFDALFTAQWKWLSSGIYFATAPANVFGTRVLDNTIASCGDFAGFLKLETKSGDPYTHLLTGLDAGVETRVYIPLTHDLYKNNNGNPLPSGGSSGHIGLPVVGKAWCSYRIPVQDYGWVKPSVTVHASTNRAHLNAPAAGGAVGATYLTKEYCAQLRAGISASLIEKTVFSLDWEQGMLSDVPYLLVSECLTQGIGRIVCGVTLSW

SEQ ID NO: 263 - protein, 598 aa, Treponema pallidum subsp. pallidum str. Nichols
MGRQVMQAGVLAGMVCAASGYAGVLTPQVSGTAQLQWGIAFQKNPRTGPGKHTHGFRTTNSLTISLPLVSKHTHTRRGEARSGVWAQLQLKDLAVELASSKSSTALSFTKPTASFQATLHCYGAYLTVGTSPSCVVNFAQLWKPFVTRAYSEKDTRYAPGFSGSGAKLGYQAHNVGNSGVDVDIGFLSFLSNGAWDSTDTTHSKYGFGADATLSYGVDRQRLLTLELAGNATLDQNYVKGTEDSKNENKTALLWGVGGRLTLEPGAGFRFSFALDAGNQHQSNAHAQTQERAILKAREVFRRVEGKLVQNLPNIMMPPGITEQTTLIEMVGLAALIAEGTLGSAIQTVLAAGALAALVSQLVPNIEQGVRDVFRSSDPRVVTAKLLAFLERAPMNALNIDALLRMQWKWLSSGIYFATAGTNIFGKRVFATTRAHYFDFAGFLKLETKSGDPYTHLLTGLNAGVEARVYIPLTYIRYRNNGGYELNGAVPPGTINMPILGKAWCSYRIPLGSHAWLAPHTSVLGTTNRFNIINPAGNLLNERALQYQVGLTFSPFEKVELSAQWEQGVLADAPYMGIAESIWSERHFGTLVCGMKVTW

SEQ ID NO: 264 - protein, 598 aa, Treponema pallidum subsp. pallidum str. Nichols; identical to SEQ ID NO: 263

SEQ ID NO: 265 - protein, 1255 aa, SARS coronavirus Frankfurt 1
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDFGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 266 - protein, 1255 aa, SARS coronavirus HSR1
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 267 - protein, 1255 aa, SARS coronavirus ZJ01; identical to SEQ ID NO: 266

SEQ ID NO: 268 - protein, 1255 aa, SARS coronavirus TW1; identical to SEQ ID NO: 266

SEQ ID NO: 269 - protein, 1255 aa, SARS coronavirus CUHK-Su10; identical to SEQ ID NO: 266

SEQ ID NO: 270 - protein, 1255 aa, SARS coronavirus Urbani; identical to SEQ ID NO: 266

SEQ ID NO: 271 - protein, 1255 aa, SARS coronavirus
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCAFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 272 - protein, 1255 aa, SARS coronavirus Tor2; identical to SEQ ID NO: 271

SEQ ID NO: 273 - protein, 1255 aa, SARS coronavirus GD01
MFIFLLFLTLTSGSDLDRCTTFDDVQAPNYTQHTSSMRGVYYPDEIFRSDTLYLTQDLFLPFYSNVTGFHTINHTFDNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFLPAQDTWGTSAAAYFVGYLKPTTFMLKYDENGTITDAVDCSQNPLAELKCSVKSFEIDKGIYQTSNFRVVPSRDVVRFPNITNLCPFGEVFNATKFPSVYAWERKRISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSYELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKDFGGFNFSQILPDPLKSTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 274 - protein, 1255 aa, SARS coronavirus CUHK-W1
MFIFLLFLTLTSGSDLDRCTTFDDVQAPNYTQHTSSMRGVYYPDEIFRSDTLYLTQDLFLPFYSNVTGFHTINHTFDNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDTWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 275 - protein, 1255 aa, SARS coronavirus BJ01; identical to SEQ ID NO: 274

SEQ ID NO: 276 - protein, 306 aa, SARS coronavirus
SGFRKMAFPSGKVEGCMVQVTCGTTTLNGLWLDDTVYCPRHVICTAEDMLNPNYEDLLIRKSNHSFLVQAGNVQLRVIGHSMQNCLLRLKVDTSNPKTPKYKFVRIQPGQTFSVLACYNGSPSGVYQCAMRPNHTIKGSFLNGSCGSVGFNIDYDCVSFCYMHHMELPTGVHAGTDLEGKFYGPFVDRQTAQAAGTDTTITLNVLAWLYAAVINGDRWFLNRFTTTLNDFNLVAMKYNYEPLTQDHVDILGPLSAQTGIAVLDMCAALKELLQNGMNGRTILGSTILEDEFTPFDVVRQCSGVTFQ

SEQ ID NO: 277 - protein, 198 aa, SARS coronavirus
AIASEFSSLPSYAAYATAQEAYEQAVANGDSEVVLKKLKKSLNVAKSEFDRDAAMQRKLEKMADQAMTQMYKQARSEDKRAKVTSAMQTMLFTMLRKLDNDALNNIINNARDGCVPLNIIPLTTAAKLMVVVPDYGTYKNTCDGNTFTYASALWEIQQVVDADSKIVQLSEINMDNSPNLAWPLIVTALRANSAVKLQ

SEQ ID NO: 278 - protein, 139 aa, SARS coronavirus
AGNATEVPANSTVLSFCAFAVDPAKAYKDYLASGGQPITNCVKMLCTHTGTGQAITVTPEANMDQESFGGASCCLYCRCHIDHPNPKGFCDLKGKYVQIPTTCANDPVGFTLRNTVCTVCGMWKGYGCSCDQLREPLMQ

SEQ ID NO: 279 - protein, 113 aa, SARS coronavirus
NNELSPVALRQMSCAAGTTQTACTDDNALAYYNNSKGGRFVLALLSDHQDLKWARFPKSDGTGTIYTELEPPCRFVTDTPKGPKVKYLYFIKGLNNLNRGMVLGSLAATVRLQ

SEQ ID NO: 280 - protein, 1588 aa, Escherichia coli 0157:H7
MNKIFKVIWNPATGNYTVTSETAKSRGKKSGRSKLLISALVAGGMLSSFGALANAGNDNGQGVDYGSGSAGDGWVAIGKGAKANTFMNTSGSSTAVGYDAIAEGQYSSAIGSKTHAIGGASMAFGVSAISEGDRSIALGASSYSLGQYSMALGRYSKALGKLSIAMGDSSKAEGANAIALGNATKATEIMSIALGDTANASKAYSMALGASSVASEENAIAIGAETEAAENATAIGNNAKAKGTNSMAMGFGSLADKVNTIALGNGSQALADNAIAIGQGNKADGVDAIALGNGSQSRGLNTIALGTASNATGDKSLALGSNSSANGINSVALGADSIADLDNTVSVGNSSLKRKIVNVKNGAIKSDSYDAINGSQLYAISDSVAKRLGGGAAVDVDDGTVTAPTYNLKNGSKNNVGAALAVLDENTLQWDQTKGKYSAAHGTSSPTASVITDVADGTISASSKDAVNGSQLKATNDDVEANTANIATNTSNIATNTANIATNTTNITNLTDSVGDLQADALLWNETKKAFSAAHGQDTTSKITNVKDADLTADSTDAVNGSQLKTTNDAVATNTTNIANNTSNIATNTTNISNLTETVTNLGEDALKWDKDNGVFTAAHGTETTSKITNVKDGDLTTGSTDAVNGSQLKTTNDAVATNTTNIATNTTNISNLTETVTNLGEDALKWDKDNGVFTAAHGNNTASKITNILDGTVTATSSDAINGSQLYDLSSNIATYFGGNASVNTDGVFTGPTYKIGETNYYNVGDALAAINSSFSTSLGDALLWDATAGKFSAKHGTNGDASVITDVADGEISDSSSDAVNGSQLHGVSSYVVDALGGGAEVNADGTITAPTYTIANADYDNVGDALNAIDTTLDDALLWDADAGENGAFSAAHGKDKTASVITNVANGAISAASSDAINGSQLYTTNKYIADALGGDAEVNADGTITAPTYTIANAEYNNVGDALDALDDNALLWDETANGGAGAYNASHDGKASIITNVANGSISEDSTDAVNGSQLNATNMMIEQNTQIINQLAGNTDATYIQENGAGINYVRTNDDGLAFNDASAQGVGATAIGYNSVAKGDSSVAIGQGSYSDVDTGIALGSSSVSSRVIAKGSRDTSITENGVVIGYDTTDGELLGALSIGDDGKYRQIINVADGSEAHDAVTVRQLQNAIGAVATTPTKYFHANSTEEDSLAVGTDSLAMGAKTIVNGDKGIGIGYGAYVDANALNGIAIGSNAQVIHVNSIAIGNGSTTTRGAQTNYTAYNMDAPQNSVGEFSVGSADGQRQITNVAAGSADTDAVNVGQLKVTDAQVSQNTQSITNLDNRVTNLDSRVTNIENGIGDIVTTGSTKYFKTNTDGVDASAQGKDSVAIGSGSIAAADNSVALGTGSVATEENTISVGSSTNQRRITNVAAGKNATDAVNVAQLKSSEAGGVRYDTKADGSIDYSNITLGGGNGGTTRISNVSAGVNNNDVVNYAQLKQSVQETKQYTDQRMVEMDNKLSKTESKLSGGIASAMAMTGLPQAYTPGASMASIGGGTYNGESAVALGVSMVSANGRWVYKLQGSTNSQGEYSAALGAGIQW

SEQ ID NO: 281 - protein, 5291 aa, Escherichia coli 0157:H7
MPASAVGALGEASYTVTANVTDSAGNSNSASHNVQVNTALPGVTINPVATDDIINAAESGNAQTISGQVTGAAAGDTVTVTLGGKTYTATVQGNLSWSVDVPAADIQAIGNGNLTVNASVTNGVGNTGSGSRDITIDANLPGLRVDTVAGDDVVNSIEHAQALVITGSSSGLAAGAALTVVINTVTYAATVLADGTWSVGVPAADVSNWPAGTVNITVSGTNTAGTTSTITHPVTVDLAAVAISINTVSGDDVINAAEKGADLTLSGSTSGVEVGQTVTVTFGGKTYTATVAGDGSWTTTVPAADLSVLRDGDATVQASVSTINGNTASATHAYSVDATAPTLAINTIATDDILNAAEAGNPLTISGSSTAEAGQTVTVTLNGVTYSGSVQADGSWSVSLPTADLSNLTASQYTVSASVSDKAGNPASANHGLAVDLTVPVLTINTVSGDDIINAAEHGQALVISGSSTGGEAGDVITVTLNSKTYTTMLDASGNWSVGVPAADVTALGSGPQTITAAITDAAGNSDDASRTVTVNLAAPTIGINTIATDDVIKATEKGADLQITGTSNQPAGTTITVTLNGQNYTATTDSNGNWSATVPASAVSALGEANYTVTANVTDTAGNSNSASHNVLVNSALPAVTINAVATDDIINAAESGNAQTISGQVTGAAQGDTVTVTLGGNTYTATVQSNLSWSVDVPAADIQALGNGDLTVNASVTNGVGNTGSGSRDITIDANLPGLRVDTVAGDDVINSIEHNQALVITGSSSGLTAGTALTVEINNVTYGATVLADGTWSLGVPAVDVSNWPAGTVNITVSGTNSAGTTSTITHPVTVDLAGVAITINTLSGDDVINAVEKGETLVVSGSTSGVEAGQTVTVTFGGKNYTTTVEANGSWTVNVPPADLAALPDGAGNVQASVSNINGNSAQADRAYSVDATAPLVTINTIASDDILNVSEAGAGITISGTTTAQAGQTLTVTLNNNTYQTTVLADGTWSVNVPAADLSGLTASSYTVTATVSDKAGNPASADHALVVDITAPDLTINTVAGDDIINAIEHGQALVVSGTSTGAAAGDVVTVTLNGKNYTTTLDASGNWSVGIPAADVTALATGSQTITASLSDRAGNSDSTTHDVTVDLSGPTLTINTVSGDDIINAAEIVVAQTISGQVTGTAVAGNTVIVTIGGNQYNATVQSDLSWSVSVPANVLQALGNGELTISASLTNSANNTGTATHDIVIDANLPGLRVDTVAGDDVINSIEHTQALVITGSSSGLAAGAALTVVINSVTYGATVLADGSWSVGVPVADVTNWPAGTVNIAVSGTNTAGTTTSISHPVTVDLAAVAITINTLSTDDVINAAEKGSDLQLSGTTSGVEAGQTITVIFGGKSYTTTVAADNTWGLTIPAVDVATLPDGAANVQASVSNVAGNSTQATHAYSVDATAPSVTINTIATDDILNAAEAGSALTISGTSTAEAGQTVTVTLNGVNYSGNVQADGSWSVSVPTGDLASLTASSYTVNASVSDKARNSASATHNLTVDLAAPVVTINTVAGDDIINATEHGQAQIISGSATGATTGNTVSVTIGTTTYTTVLDANGNWSIGVPASVISALAQGDVTITATVTDSAGNSGTASHTVTVALGAPVLAINTIAVDDIINAAEKGADLAITGTSNQPAGTQITVTLNGQNYTTTADASGNWSVTVPASRVSALGEATYTVTAAATDADGNSGSASHNVQVNTALPGVTINVVATDDIINAAEAGVEQTISGQVTGAAAGDTVTVTLGGATYTATVQANLSWSVDVPASALQELGNGELTISASVTNSVGNTGNGTREITIDANLPGLRVDTVAGDDVVNIIEHGQALVITGSSSGLAAGSNVTLTINGQTYVAAVLADGTWSVGVPAVDVSAWPAGSVTIAASGSTSAGNPVSVTHPVTVDLSAVAVSINAITADDVINAAEKGAALTLSGSTSGVEAGQTVTVTFGGKTYSATVAANGSWSTSVPAADMAALRDGDASAQASVSNVNGNSATTTHAYSVDASAPTVTINTIAGDDILNAAEAGAALTITGSSTAEAGQTVTVTLNGTNYTGTVQTDGSWSVSVPSADLSTLTASNYTVNAAVSDKAGNPASVNHNLTVDTSVPVVTINTVAGDDVINATEHAQAQIISGSATGAATGSTVTVTIGTNTFTTVLDASGNWSVGVPASVVSALANGTVTINASVTDAGGNSGSATHQVTVNTGLPTITFNAISGDNILNADEKGQPLTISGGSTGLATGAQVTVTLNGHNYSATTDASGNWTLTVPVSDLAALGQANYTVSASATSAAGNTASSQANLLVDSGLPDVTINTVAGDDIINAAEAGADQTISGVVTRAAAGDTVTVTLGGNTYTATVQSNLSWSVSVPTADLQALGNGDLTITASVTNANGNTGSGTRDITIDANLPGLRVDTVAGDDIVNSIEHGQALVITGGSSGLNAGAVLTVTINSVAYSATVQADGSWSVGIPAANVSAWPAGPLTVEVDGQSSANNPVSVSHPFTVDLTAVAISINTVASDDVINAAEKGTNLTLSGSTSGIESGQTVTVTFGGKTYTASVAANGSWSVNVPAADLATLPEGAANVQASVSSASGNSASATHAYSVDASAPTLTINTIASDDILNAAEAGSPLTISGTSTAETGQTVTVTLNGATYTGTVQADGSWSVSVPTSALGALNASNYTVSATVNDKAGNPGSASHNLAVDTTAPVLTINTVAGDDIINDAEHAQALVISGTSSGGEAGDVVSVVLNGKTYTTTLDASGNWSVGVPAADVTALGSGAQTITASVSDRAGNSDDASRTVTVSLSAPVISINTIAGDDVINATEKGSDLALSGTSDQPAGTAITVTLNGQNYSATTDASGNWSVTVPASAVSALGEATYSVTASVTNAQGNSSTASHNVQVNTALPGITINPVATDDIINASEAGSAQTISGQVTGAAAGSTVTVELGGKTYTATVQADLSWNVSVPAADWQALGNGELTVNASVTNAVGNTGSGTRDITIDASLPGLRVDTVAGDDVVNIIEHAQAQVITGSSSGFAAGTALTVVINNQTYAATVLANGSWSVGVPATDVSNWPAGTLNITVSGANSAGTQTSITHPLTVDLTAVAISMNSITSDDAINAAEKGAALTLSGSTSGVEAGQTVTVTFGGKTYTTTVAANGSWSTTVPAADLAALRDGDASAQVRVTNVNGNSATATHEYSVDSAAPTVTINTIASDNIINASEAAAGVTVSGTSTAQTGQTLTVTLNGTNYQTTVQTDGSWSLTLPASDLTALANNGYTLTATVSDLAGNLGSASKGVTVDTTAPVISFNTVAGDDVINNVEHIQAQIISGTATGAVAGDRLVVTIAGQQYVTSTDASGNWSVGVPASVISGLADGTVTISATITDSAGNSSTQTHNVQVNTAAVSLSVSTISGDNLINAAEAGSALTLSGTGTNFATGTVVTVLLNGKGYSATIQSNGSWSVNVPAADVAALSDGTSYTVSASAQDSAGNGNSSTQTHNVQVNTAAVSLSVSTISGDNLINAAEAGSALTLSGTGTNFATGTVVTVLLNGKGYSATIQSNGSWSVNVPAADVAALSDGTSYTVSASAQDSAGNSATASRSVAVDLTAPVISINTVSTDDRLNAAEQQQPLTLNGSTSAEVGQTVTVTFGGKTYTATVAANGTWALNVPAVDLAALGQGAQTITASVNDRAGNPGQATHALTVDTVAPTVTIATVAGDDIINNAEQLAGQTISGTTTAEVGQTVTVTFNGQTWSATVGSGGSWSVFIPAQQFAGLSDGSYTISATVSDQAGNPGSASRGVTLNGDVPTVTINTFAGDDVVNAAEHGSSLVISGTTTAPVGQTLTLTLNGKTYTTTVQTGGSWSYTLGSADVTALADGNAYVINASVSNAIGNTGSSNHTITVDLSAPAMGINIDSLQADTGLSASDFITSVSPVVVNGSLTAALASNETAQISIDGGTTWTTLTVTGTTWRYNDSRTLTDGNYLYQVRVIDAAGNVGATDSQNVVIDTTAPDPAVKTIAISAITTDMGLITNDFVTSDTTLAVSGTLGATLSAGEFAQISLDGGVTWTTLTVVGTSWSYADGHTLTDGTWNYTVRVVDLAGNVGQTATQNVVVDTTSPEAAKSITITGISDDTGTSSSDFITSDTTLTVRGVLGAALGANEFAQISTDNGATWVNVTVAADSLNWSYVDGRTLTNGTTTWQVRVVDLAGNVGATSSQSALIDTVNPAQVLTIASISTDTGSSATDFITSDTMLTLTGSLGAGLASGEVAQISLDSGATWTTLTTNGTQWTYTDSRTLTDGSYVYQVRVLDLAGNTGPVVSKTVVVDTINPTATPTIVSYTDDVGQRQGTLSSSQATDDTTPLLNGVLSAPLASGEVVYLYRNGLLLGAVTMVGALNWTYSDSGLVSGAYTYSARVVDLAGNITSSSDFVLTVDTSIPTTLAQITSQTTRDTTPIISGVITAALASGQYVEVVINGKTYTSEPGGAVVVDPAHNTWYVQLPDTDALTVSATAYTVTAQVKSSAGNGNNANISNGTVTVNAAIDYTPTWTTASKTTAWGLTYGLDSHGMWTVLANQQVMQSTDPLTWSKTALTLYQSGNNYATSSIADYDRNGTGDLFITRDDYGTGYINGFTNNGDGTFSSAIQVTVGTLTWYGSIVAFDKEGDGYLDFWIGDAGGPDSNTFLWNNAGTLVGNSTTSNSGGSATVGGAVTGYLSLNEGSGVDLNNDGRIDLVQHTYNLNNYYTLSSLINQGNGTFVWGQNTTNTFLSGAGSGAMSSSVSMTWADFDGDGDMDLFLPASQGRANYGSLLFNTNGVLGCPVAVGATATTYASQFSLAVDWNHDGLMDIARIAQTGQSYLYTNVSNASNWTQSALGGSQSGTTSGVAAMDYDWDGAVDVLVSKQSGSVFLSRNTNTVSYGTSLHLRITDPNGINVYYGNTVKLYNSAGVLVATQIINPQSGMGVNDTSALVNFYGLNAGETYNAVLIKSTGTTASNIDQTVNTSWGGLQATDATHAYDLSAEAGTASNNGKFVGTGYNDTFFATAGTDTYDGSGGWVYSSGTGTWLANGGMDVVDFRLSTVGVTANLSSTAAQATGFNTSTFTNIEGISGSNFNDILTGSSGDNQLEGRGGNDTLNIGNGGHDTLLYKLLNASDATGGNGSDVVNGFTVGTWEGTADTDRIDIRELLQGSGYTGNGKASYVNGVATLDAQAGNIGDFVKVTQSGSDTIVQIDRDGTGGTFATTNVVTLTGVHTDLATLLANHQLMVV

SEQ ID NO: 282 - protein, 1345 aa, Escherichia coli 0157:H7
MGVHTAEATLPNGNNDTKIVNIAPDASNAQVTLNIPAQQVVTNNSDSVQLTATVKDPSNHPVAGITVNFTMPQDVAANFTLENNGIAITQANGEAHVTLKGKKAGTHTVTATLSNNNTSDSQPVTFVADKTSALVVLQISKNEITGNGVDSATLTATVKDQFDNEVNNLPVTFSTASSGLTLTPGESNTNESGIAQATLAGVAFGEQTVTASLANNGASDNKTVHFIGDTAAAKIIELTPVPDSIIAGTPQNSSGSVITATVVDNNGFPVKGVTVNFTSNAATAEMTNGGQAVTNEQGKATVTYTNTRSSIESGARPDTVEASLENGSSTLSTSINVNADASTAHLTLLQALFDTVSAGDTTNLYIEVKDNYGNGVPQQEVTLSVSPSEGVTPSNNAIYTTNHDGNFYASFTATKAGVYQVTATLENGDSMQQTVTYVPNVANAEISLAASKDPVIANNNDLTTLTATVADTEGNAIANSEVTFTLPEDVRANFTLGDGGKVVTDTEGKAKVTLKGTKAGAHTVTASMAGGKSEQLVVNFIADTLTAQVNLNVTEDNFIANNVGMTRLQATVTDGNGNPLANEAVTFTLPADVSASFTLGQGGSAITDINGKAEVTLSGTKSGTYPVTVSVNNYGVSDTKQVTLIADAGTAKLASLTSVYSFVVSTTEGATMTASVTDANGNPVEGIKVNFRGTSVTLSSTSVETDDRGFAEILVTSTEVGLKTVSASLADKPTEVISRLLNAKADINSATITSLEIPEGQVMVAQDVAVKAHVNDQFGNPILNESVTFSAEPPEHMTISQNIVSTDTHGIAEVTMTPERNGSYMVKASLANGSSYEKDLVVIDQKLTLSASSPLIGVNSPTGATLTATLTSANGTPVEGQVINFSVTPEGATLSGGKVRTNSSGQAPVVLTSNKVGTYTVTASFHNGVTIQTQTIVKVTGNSSTAHVASFIADPSTIAATNSDLSTLKATVEDGSGNLIEGLTVYFALKSGSATLTSLTAVTDQNGIATTSVRGAITGSVTVSAVTTAGGMQTVDITLVAGPADASQSVLKNNRSSLKGDFTDSAELHLVLHDISGNPIKVSEGLEFVQSGTNAPYVQVSAIDYSKNFSGEYKATVTGGGEGIATLIPVLNGVHQAGLSTTIQFTRAEDKIMSGTVLVNGANLPTTTFPSQGFTGAYYQLNNDNFAPGKTAADYEFSSSASWVDVDATGKVTFKNVGSKWERITATPKTGGPSYIYEIRVKSWWVNAGDAFMIYSLAENFCSSNGYTLPLGDHLNHSRSRGIGSLYSEWGDMGHYTTEAGFHSNMYWSSSPANSNEQYVVSLATGDQSVFEKLGFAYATCYKNL

SEQ ID NO: 283 - protein, 1461 aa, Escherichia coli 0157:H7
MSLIIDVISRKTSVKQTLINPGDVTVVIYEPSVVQVHAQASAVARYVREGNDLLIYMQDGTVIRCNGYFLQAANTAEQSELVFADGQQLTHITFADTAAGGLAPVELTAQTTAIESIAPFLDTVAQTSAFPWGWLAGAAVGGGALGALLASGGDGDSKTEVINNPTPPAEPGNATPSFLVTDNQGDQRGILATNDITDDTTPTFSGSGQAGATIQIKDSNGNTIASTQVDNNGHWSVSLPTQSAGEHTWSVVQIVGSTITDAGSITLTIDNSQASVQVATTAGDNIINASEQAAGFTLSGTSSHLAQGTELTVTLNGKTYTTSVGANGAWSVQVPTADAQALGEGNQAVLVSGKDATGNTVTGAQLLTVDTQPPTLAINTIAQDNIISAAEHNVALVLSGTSNAEAGQTVTLTVNGKSHTATVGSDGTWQVTLPATEVQALAEGNYAVNASVSDRAGNTTSHSANFTVDTSAPVVSVNTVAGDDILNNAEQAVAQIISGQVSGASPGDTVTVKLGTHVLTGIVLADGSWNVALDPAVTRTLDRGANTIFVTVTDAAGNTGAASRAITLVGVSPLITINTVSGDDIISGAEKGAPLTLTGSTQQAETGQTVTVTLAGQSFTTTVQADGSWSLTVPAAAMGNLPDGAVAITASVTDLSGNTGNTSRTITVDSQAPALSIDPLTADNIINAAESGQDLPITGTTDAQPGQTVTVTLNGQTYQGVVQPDGTWSVTVPAANVGALADGNATVTASVNDVAGNPSSVSRVALVDATPPVVTINPVATDNVINTPEHAQAQIISGTVTGAQAGDIVTVTLNNVDYTTVVDGSGNWSLGVPASVVSGLADGSYPVSVSVTDKAGNTGSQSLTVTVNTAAPLIGINSIAGDDVINASEKGADLQITGTSDQPVNTAITVTLNGQNYTTTTDASGNWSVTVPASAVTALGQANYTVTAAVTSDIGNSATASHNVLVDSALPGVTINPVATDDIINAAEAGVAQTISGQVTGAEDGDTVTITLGGNTYTATVGSNLTWSVDVPAADIQALGNGDLTVNASVTNQNGNTGSGTRDITIDANLPGLRVDTVAGDDVVNIIEHGQALVVTGSSSGLAESTPLTVTINNVEYTTAVQADGSWSVGVTAAQVSAWPAGTVNIAVSGESSAGNSVSITHPVTVDLTPAAITINTIATDDVINAAEKGADLTLSGTTTNVEPGQTVTVTFGGKNYTASVASDGSWTATVPAADLASLPEGSASALASVSNINGNSASAVHNYSVDSSAPTIIINTVASDNIVNASEADAGVTVSGSTTAEAGQIVTITLNSPTVQTYQATVQADGSWSINIPAADLEALTDGSHTLTATVNDKAGNPASTTHNLAVDLTVPVLTINTIAGDDIINATEHGQALVISGSSTGGEAGDVVTVTLNSKTYTTTLDASGNWSVGVPAADVTALGSGPQTVTATVTDAAGNSDN

SEQ ID NO: 284 - protein, 1343 aa, Escherichia coli 0157:H7
MNRIYRVIWNCTLQVFQACSELTRRVGKTSTVNLRKSSGLTTKFSRLTLGVLLALSGSVSGASLEVDNGQITNIDTDVAYDAYLVGWYGTGVLNILAGGNASLTTITTSVIGGNEDSEGTVNVLGGTWRLYDSGNNARPLNVGQSGTGTLNIKQKGHVDGGYLRLGTQAAGVGTVNVEGEDSVLTTELFEIGSYGTGSLNITDKGYVTSSIVAILGYQANSNGKVVVEKGGEWLIKNNDSSIEFQIGNQGTGEATIREGGLITAENTIIGGNATGVGTLNVQDQDSVITVRRLYNGYFGNGAVNISNNGLINNKEYSLVGVQDGSHGVVNVTDKGHWNFLGTGEAFRYIYIGDAGDGELNVSREGKVDSGIITAGMKETGTGNLTVKDKNSVITNLGTNLGYDGHGEMNISNEGLVVSNGGSSLGYGETGVGKVSITTGGIWEVNKNVYTTIGVAGVGNLNISDGGKFVSQNITFLGDKASGIGTLNLMDATSSFDTVGINVGNFGSGIVNVSNGATLNSTGYGFIGGNASGKGIVNISTDSLWNLKTSSTNAQLLQVGVLGTGELNITTGGIVKARDTQIALNDKSKGDVRVDGQNSLLETFNMYVGTSGTGTLTLTNSGTLNVEGGEVYLGVFEPAVGTLNIGAAHGEAAADAGFITNATKVEFGSGEGVFVFNHTNNSDAGYQVDMLITGDDKDGKVIHDAGHTVFNAGNTYSGKTLVNDGLLTIASHTADGVTGMGSSEVTIASPGTLDILASTNSAGDYTLTNALKGDGLMRVQLSSSDKMFGFTHATGTEFAGVAQLKDSTFTLERDNTAALTHAMLQSDIENTTSVNVGEQSIGGLAMNGGTLIFDTDIPAATLAEGYISVDTLVVGASDYTWKGRNYQVNGTGDVLIGVPKPWNDPMANNPLTTLNLLEHDDNHVGVQLVKAQTVIGSGGSLTLRDLQGDEVEADKTLHIAQNGTVVAEGDYGFRLTTAPGDGLYVNYGLKALNIHGGQKLTLAEHGGAYGATADMSAKIGGEGDLAINTVRQVSLSNGQNDYQGATYVQMGTLRTDADGALGNTRELNISNAAIVDLNGSTQTVETFTGQMGSTVLFKEGSLTVNKGGISQGELTGGGNLNVTGGTLAVEGLNARYNALTSVSPNAEVSLDNTQGLGRGNIANDGLLTLKNVTGELRNSISGKGIVSATARTDVELDGDNSRFVGQFNIDTGSALSVNEQKNLGDASVINNGLLTISTERSWAMTHSISGSGDLTKLGTGILTLNNDSSAYQGTTDIVGGEIAFGSDSAINTASQHINIHNSGVMSGNVTTAGDVNVMSGGTLRVAKTTIGESAATWRMAARFK

SEQ ID NO: 285 - protein, 547 aa, Escherichia coli 0157:H7
MGIKQHNGNTKADRLAELKIRSPSIQLIKFGAIGLNAILFSPLLIAADTGSQYGTNITINDGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKIKTDGSTGVYIGGLNGNNANGAARFTATDLTIDVQGYSAMGINVQKNSVVDLGTNSSIKTSGDNAHGLWSFGQVSANALTVDVTGAAANGVEVRGGTTTIGADSHISSAQGGGLVTSGSDATINFSGTAAQRNSIFSGGSYGASAQTATAVINMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFTTLNVENLSGNSTFIMRADVVGEGNGVKPWA

SEQ ID NO: 286 - protein, 234 aa, Escherichia coli 0157:H7
MGIDSRNDIPEGIATLGAFMGYSHSHIGFDRGGHGSVDSYSLGGYASWEHESGFYLDGVVKLNRFESNVAGKMSSGGAANGSYHSNGLGGHIETGMRFTDGNWNLTPYASLTGFTADNPEYHLSNGMESKSVDTRSIYRELGATLSYNMRLGNGMEVEPWLKAAVRKEFVDDNRVKVNSDGNFVNDLSGRRGIYQAGIKASFSSTLSGHLGVGYSNGAGMESPWNAVAGVNWSF

SEQ ID NO: 287 - protein, 195 aa, Escherichia coli 0157:H7
MKKKVLAIALVTVFTGMGVAQAADVTAQAVATWSATAKKDTTSKLVVTPLGSLAFQYAEGIKGFNSQKGLFDVAIEGDSTATAFKLTSRLITNTLTQLDTSGSTLNVGVDYNGAAVEKTGDTVMIDTANGVLGGNLSPLANGYNASNRTTAQDGFTFSIISGTTNGTTAVTDYSTLPEGIWSGDVSVQFDATWTS

SEQ ID NO: 288 - protein, 201 aa, Escherichia coli 0157:H7
MTAESYDDNYLDDEDADWTATGQGQKSAGDTSFTLAWKPGEEGQKGLIGWFESGDVRAYKIRFPNGTVDVFRGWVSSIGKAVTAKEVITRTVKVTNVGKPSVAEERSKITPVSAIKVTPTSGTVAKGKTTTLTVSFEPESATDKTFRAVSADPSKATISVKDMTITVNGVATGKVQIPVVSGNGQFAAVAEVTVTEAGAAG

SEQ ID NO: 289 - protein, 201 aa, Escherichia coli 0157:H7; identical to SEQ ID NO: 288

SEQ ID NO: 290 - protein, 715 aa, Escherichia coli 0157:H7
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 291 - protein, 213 aa, Escherichia coli 0157:H7
MTKMSRYALITALAMFLAGCVGQREPAPVEEVKPAPEQPAEPQQPVPTVPSVPTIPQQPGPIEHEDQTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 292 - protein, 123 aa, Escherichia coli 0157:H7
MKSKVLALLIPALLGAGAAHAAEVYNKDGNKLDLYGKVDGLHYFSDNSAKDGDQSYARLGFKGETQINDQLTGYGQWEYNIQANNTESSKNQSWTRLAFAGLKFSDYGSFDYGRNYGLDRYAA

SEQ ID NO: 293 - protein, 250 aa, Escherichia coli 0157:H7
MATPNPLEPVKGAGTTLWVYNGKGDAYANPLSDDDWQRLAKVKDLTPGEMTAEPYDDNYLDDEDADWTATGQGQKSAGDTSFTLAWKPGEEGQKGLIGWFESGDVRAYKIRFPNGTVDVFRGWVSSIGKAVTAKEVITRTVKVTNVGKPSVAEERSEITPATAIKVTPTSGTVAKGKTTTLTVSFEPESATDKTFRAVSADPSKATISVKDMTITVNGVATGKVQIPVVSGNGQFAAVAEVTVTEAGAAG

SEQ ID NO: 294 - protein, 250 aa, Escherichia coli 0157:H7; identical to SEQ ID NO: 293

SEQ ID NO: 295 - protein, 255 aa, Escherichia coli 0157:H7
MGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADVGATYYFNKNMSTYVDYKINLLDEDDSFYAANGISTDDIVALGLVYQF

SEQ ID NO: 296 - protein, 379 aa, Haemophilus influenzae Rd
MGFIMKLTKTALCTALFATFTFSANAQTYPDLPVGIKGGTGALIGDTVYVGLGSGGDKFYTLDLKDPSAQWKEIATFPGGERNQPVAAAVDGKLYVFGGLQKNEKGELQLVNDAYRYNPSDNTWMKLPTRSPRGLVGSSGASHGDKVYILGGSNLSIFNGFFQDTVAAGEDKAKKDEIAAAYFDQRPEDYFFTTELLSYEPSTNKWRNEGRIPFSGRAGAAFTIQGNELVVVNGEIKPGLRTAETHQGKFTAKGVQWKNLPDLPAPKGKSQDGLAGALSGYSNGHYLVTGGANFPGSIKQFKEGKLHAHKGLSKAWHNEVYTLNNGKWRIVGELPMNIGYGFSVSYNNKVLLIGGETDGGKALTSVKAISYDGKKLTIE

SEQ ID NO: 297 - protein, 101 aa, Haemophilus influenzae Rd
MGEQYMLTTILSFLIVTTVVAYVSWLKTKGDDLKSSKGYFLAGRGLSGLVIGCSMVLTSLSTEQLIGVNAVSYKGNFSVIAWTVPTVIPLCFLALYIIGWL

SEQ ID NO: 298 - protein, 668 aa, Helicobacter pylori J99
MKNQHKNPLTKALMKTYPYNHFLFFCFILGAFLLGLLSPAYALSIITTKEIDANLLNGAIESRVVLGKRVFKVEAHGFYFRNNATNSIDIEITSLLRDNQSFPLTSSAKTSLKIPPNAKIKKSTILVLKGENAEEVAKILGVSKEEYQKLENIAQTKAANDPMYANTPFSNGSDSSFYDNNPNSPSNNAINGKDGANGSNGYGANGNDGVNGISGSNGANGSHSNNNAIGSGIDTDGVLGVDGVNGSSSSSGGSVGGYENNFTNHGSTNNNTGGYDNFNNGSSSGGSLGNGGLFPIPFGNGDTNNSNNSTNTTSPTNGSSSNNATNPSSQENNYSSQYCKVPELSPNNTMKLDVIAKDGSCISMNALRDDTKCAYRYDFEAGKAIKQTQYYYVDRENKTQNIGGCVDLQGAQYAMQLYKDDSKCALQTTSDKGYGMGKTQTFQTEIVFRGMDNLIHVAVPCSDYARVQDRIVRYEKNDKTQTLTPIVDQYYNDPNNPNKQEILNRGIATQLSSQYQEFACGQWEYNDAKLEAKRPTMLKSYNKLNGEWVEVTPCNFEAGIKSGAVVSPYVMGVPSSKVLSDITTSHYFRIERKNYGEREQCQKLYGVNRCQPQYSILILVSPIGAPLTKPLPPKPLNLIYAQPKIMKNTPQPIILSPLKPPSTGLKAF

SEQ ID NO: 299 - protein, 383 aa, Helicobacter pylori J99
MPVIRVLVMLATMMMKLVKTAKEKKVFKNVGISIMGIAFWEAIKDSIKKQIKKSDWICGNVKTADDYLKTHPNSWFNSAIGVTAITAMLMNVCFADDQSKKEVAQAQKEAENARDRANKSGIELEQEEQKTEQEKQKTEQEKQKTEQEKQKTEQEKQKTEQEKQKTSNIETNNQIKVEQEQQKTEQEKQKTNNTQKDLVNKAEQNCQENHNQFFIKKLGIKAGIAIEIEAECKTPKPTKTNQTPIQPKHLPNSKQPHSQRGSKAQELIAYLQKELESLPYSQKAIAKQVDFYRPSSIAYLELDPRDFNATEEWQKENLKIRSKAQAKMLEMRSLKPDPQAHLSTSQSLLLVQKIFADVSKEIKVVANTEKKVEKAGYGYSKRM

SEQ ID NO: 300 - protein, 267 aa, Helicobacter pylori J99
MNYPNLPNSALEISEQPEVKEITNELLKQLQNALRSNAHFSEQVELSLKCIVRILEVLLSLDFFKNANEIDSSLRNSIEWLTNAGESLKLKMKEYERFFSEFNTSMHANEQEVTNTLNANAENIKSEIKKLENQLIETTTRLLTSYQIFLNQARDNANNQITKNKTQSLEAITQAKNNANNEISNNQTQAITNITEAKTNANNEISNNQTQAITNINEAKESATTQINANKQEAINNITQEKTQATSEITEAKKTDHYQNIDFFEFE

SEQ ID NO: 301 - protein, 211 aa, Helicobacter pylori J99
MKFFSKDLFKKVTPLFLSVYFLSPTLTQAKSRFYVASQYQVGKMIMKKYNDLKRTIEGASFSLGWEINPTNYWFYSRYYFFMDYGNVILNKRTGAQANMFTYGFGGDLIMEYNKNPLYVFSLFYGMQVAENTWTISKHSANFIIDDWRSIQGFSLKTSNFRMLGLVGFKFQTVLFHHDASIEVGIKWPFAFEYDSPFVRLFSVFISHTFYL

SEQ ID NO: 302 - protein, 173 aa, Helicobacter pylori J99
MKKFTLSLFLCCTLLNAEEDIFRNNTNETDLTNSFEHGKENNNLIPAKSDSLESFKEQENKEKAKQLMDLKALQSVYFSKNRKLQDNNFNVLYVAGNTNKIRLRYAMTTTFIFDNDPIIYVSLGDPSDFELTYPTNDHYDLSNMLVIKPLLIGVDTNLTVVGASGTIYTLLFV

SEQ ID NO: 303 - protein, 221 aa, Mycoplasma pneumoniae
MLDYVPWIGNGYRYGNNHRGSNSSTSGVTTQGQSQNASSNEPAPTFSNVGVGLKANVNGTLSGSRTTPNQQGTPWLTLDQANLQLWTGAGWRNDKNGQSDENYTNFASAKGSTNQQGSTTGGSAGNPDSLKQDKADKSGDSVTVAEATSGDNLTNYTNLPPTSPPHPTDRTRCHSPTRTTPSGCSCSCAACWAASRCWSIRVGKMITVSLIPPTKNGLTPN

SEQ ID NO: 304 - protein, 527 aa, Mycoplasma pneumoniae
MDDITAPQTSAGSSSGTSTNTSGSRSFLPTFSNVGVGLKANVQGTLGGRQTTTTGNNIPKWATLDQANLQLWTGAGWRNDKTTSGSTGNANDTKFTSATGSGSGQGSSSGTNTSAGNPDGLQADKVDQNGQVKTSVQEATSGDNLTNYTNLPPANLTPTADWPNALSFTNKNNAQRAQLFLRGLLGSIPVLVNKSGQDDNSKFKAEDQKWSYTDLQSDQTKLNLPAYGEVNGLLNPALVETYFGNTRASGSGSNTTSSPGIGFKIPEQSGTNTTSKAVLITPGLAWTPQDVGNIVVSGTSFSFQLGGWLVTFTDFIKPRAGYLGLQLTGLDVSEATQRELIWAKRPWAAFRGSWVNRLGRVESVWDFKGVWADQAQLAAQAATSSTTTTATGATLPEHPNALAYQISYTDKDSYKASTQGSGQTNSQNNSPYLHFIKPKKVESTTQLDQGLKNLLDPNQVRTKLRQSFGTDHSTQPQPQSLKTTTPVFGRSSGNLSSVFSGGGAGGGSSGSGQSGVDLSPVERVSGH

SEQ ID NO: 305 - protein, 737 aa, Mycoplasma pneumoniae
MLKLAVGIFISPTLTRFSTGFNLAGSVLDQVLDYVPWIGNGHRYGNNHRGVDDITAPKTGAGSSSGTSTNTSGSRSFLPTFSNVGVGLKANVQGTLGGSQTTTTGKDIPKWPTLDPANLQLWTGAGWRNDKASNKQSDENHTTFKSATGSGQQGGSTTGGSAGNPDSLKQDKISKSGQNLTTQDGAPQSNSTTESASNYDHLPPNLTPTSDWPNALSFTNKNNAQRAQLFLRGLLGSIPVLVNRSGSDDSNKFQATDQKWSYTDLKSDQTKLNLPAYGEVNGLLNPALVETYFGTTRAGGSGSNTTSSPGIGFKIPEQNNDSKAVLITPGLAWTPQDVGNLVVSGTSLSFQLGGWLVTFTDFVKPRAGYLGLQLTGLDASDATQRALIWAKRPWAAFRGSWVNRLGRVESVWDLKGVWQDQAQAAAQAATTAAATGDALPEHPNALAYQISSTDKDSYKASTQSSGQTNSQNTSPYLHLIKPKKVENTTQLDQGLKTCWTPTRFAPSCAKALVQTIPPKPNPNPSKQPHRCLGRIVVTLAVCLVVGVLEEQTAPIRWTSPPLNGWVGGLWGNYPVGVGGIVVRILKVCKTLLFISIFISIFFLNCSLTLFIWTTASLATGLTVVGHFTSTTTTLKRQQFSYTRPDEVALRHTNAINPRLTPWTYRNTSFSSLPLTGENPGAWALVRDNTAKGITAGSGSQQTTYDPTRTEAALTTATTFVLRRYDLAGRCTTSTFRS

SEQ ID NO: 306 - protein, 465 aa, Mycoplasma pneumoniae
MLDYIPWIGNGHRYGNDHRGSNSSTSGVTTQGQQSQNASGTEPASTFSNVGVGLKANVQGTLGGSQTTTTGKDIPKWPTLDQANLQLWTGAGWRNDKASSGQSDENHTKFTSATGSGQQGSSSGTTNSAGNPDSLKQDKVDKSGDSVTVAETTSGDNLTNYTNLPPNLTPTADWPNALSFTNKNNAQRAQLFLRALLGSIPVLVNKSGQDDSNKFQATDQKWSYTELKSDQTKLNLPAYGEVNGLLNPALVEVYGLSSTQGSSTGAGGAGGNTGGDTNTQTYARPGIGFKLPSTDSESSKATLITPGLAWTAQDVGNLVVSGTSLSFQLGGWLVTFTDFIKPRSGYLGLQLTGLDANDSDQRELIWAPPALNRLSWQLGQPLGPRGECVGFQGGVGGSSSVRLASSYKYHHRNEGYLIGAHQCFGLSGELYRPGFVQGFHSKLRPKPKHLPLPALGAGEKSRFLW

SEQ ID NO: 307 - protein, 347 aa, Mycoplasma pneumoniae
MLGSIPVLVNRSGSDSNKFQATDQKWSYTDLQSDQTKLNLSAYGEVNGLLNPALVETYFGTTRTSSTANQNSTTVPGIGFKIPEQNNDSKATLITPGLAWTPQDVGNLVVSGTTVSFQLGGWLVTFTDFVKPRAGYLGLQLSGLNASDSDQRELIWAPRPWAAFRGSWVNRLGRVESVWDLKGVWADQAQLAAQAATSSTTTTATGATLPEHPNALAYQISYTDKDSYKASTQGSGQTNSQNNSLYLHLIKPKKVESTTQLDQGLKNLLDPNQVRTKLRQSFGTDHSTQPQPQSLKTTTPVFGAMSGNLGSVLSGGGAGGAGSTNSVDLSPVERVSGSLTINRNFSY

SEQ ID NO: 308 - protein, 413 aa, Mycoplasma pneumoniae
MGQQGQSGTSAGNPDSLKQDKISKSGDSLTTQDGNATGQQEATNYTNLPPNLTPTADWPNALSFTNKNNAHRAQLFLRGLLGSIPVLVNRSGSDSNKFQATDQKWSYTDLQSDQTKLNLPAYGEVNGLLNPALVETYFGNTRAGGSGSNTTSSPGIGFKIPEQNNDSKATLITPGLAWTPQDVGNLVVSGTSLSFQLGGWLVSFTDFIKPRAGYLGLQLSGLDASDSDQRELIWAKRPWAAFRGSWVNRLGRVESVWDLKGVWADQAQLAAQAATSEASGSALAPHPNALAFQVSVVEASAYSSSTSSSGSGSSSNTSPYLHLIKPKKVESTTQLDQGLKNLLDPNQVRTKLRQSFGTDHSTQPQSLKTTTPVFGTSSGNIGSVLSGGGAGGGSSGSGQSGVDLSPVERVSGH

SEQ ID NO: 309 - protein, 256 aa, Mycoplasma pneumoniae
MGLQLSGLDASDSDQRELIWAKRPWAAFRGSWVNRLGRVESVWDLKGVWADQAHSAVSESQAATSSTTTTATGDTLPEHPNALAYQISSTDKDSYKASTQGSGQTNSQNTSPYLHLIKPKKVTASDKLDDDLKNLLDPNEVRVKLRQSFGTDHSTQPQPQPLKTTTPVFGTNSGNLGSVLSGGGTTQDSSTTNQLSPVQRVSGWLVGQLPSTSDGNTSSTNNLAPNTNTGNEVVGVGDLSKRASIESSRLWIALKP

SEQ ID NO: 310 - protein, 438 aa, Mycoplasma pneumoniae
MRDNTAKGITAGSGSQQTTYDPARTEATLTTTTFALRRYDLAGRALYDLDFSKLNPQTPTRDANCQITFNPFGGFGLSGSAPQQWNEVKNKVPVEVAQDPTDPYRFAVLLVPRSVVYYEQLQRGLALPNQGSSSGSGQQNTTIGAYGLKVKNAEADTAKSNEKLQGDESKSSNGSSSTSTTTQRGSTNSDTKVKALKIEVKKKSDSEDNGQLQLEKNDLANAPIKRGEESGQSVQLKADDFGTAPSSSGSGGNSNPGSPTPWRPWLATEQIHKDLPKWSASILILYDAPYARNRTAIDRVDHLDPKVMTANYPPSWRMPKWNHHGLWDWKARDVLFQTTGFDESNTSNTKQGFQKEADSDKSAPIALPFEAYFANIGNLTWFGQALLVFGGNGHVTKSAHTAPLSIWLYIYLVKAVTFRLLLANSLLSKSNIYKKTAN

SEQ ID NO: 311 - protein, 422 aa, Mycoplasma pneumoniae
MRDNIAKGITAGSNTQQTTYDPTRTEATLTTATTFALRRYDLAGRALYDLDFSKLNPQTPTRDQTGQITFNPFGGFGLSGAAPQQWNEVKDKVPVEVAQDPSNPYRFAVLLVPRSVVYYEQLQRGLALPNQGSSSGSGQQNTTIGAYGLKVKNAEADTAKSNEKLQGYESKSSNGSSSTSTTQRGGSSNENKVKALQVAVKKKSGSQGNSGDQGTEQVELESNDLANAPIKRGSNNNQQVQLKADDFGTAPSSSGSGTQDGTPTPWTPWLTTEQIHNDPAKFAASILILYDAPYARNRTAIDRVDHLDPKVMTANYPPSWRTPKWNHHGLWDWKARDVLLQTTGFFNPRRHPEWFDGGQTVADNEKTGFDVDNSENTKQGFQKEADSDKSAPIALPFEAYFANIGNLTWFEQALLVFGICLS

SEQ ID NO: 312 - protein, 127 aa, Mycoplasma pneumoniae
MLWPFRWVWWKRVLTSQTRAPAKPNPLTVPPTCTWWSLRKLPNPTKLDDDLKNLLDPNEVRARMLKSFGTENFTQPQPQPQALKTTTPVFGTSSGNLGSVLSGGGYHAGLKHHQSTVTRSTGEWVDR

SEQ ID NO: 313 - protein, 428 aa, Mycoplasma pneumoniae
MRDNSAKGITAGSESQQTTYDPTRTEAALTASTTFALRRYDLAGRALYDLDFSRLNPQTPTRDQTGQITFNPFGGFGLSGAAPQQWNEVKNKVPVEVAQDPSNPYRFAVLLVPRSVVYYEQLQRGLALPNQGSSSGSGQQNTTIGAYGLKVKNAEADTAKSNEKLQGDESKSSNGSSSTSTTTQRGGSSGDTKVKALQVAVKKKSGSQGNSGEQGTEQVELESNDLANAPIKRGEESGQSVQLKAADFGTTPSSSGSGGNSNPGSPTPWRPWLATEQIHKDLPKWSASILILYDAPYARNRTAIDRVDHLDPKVMTANYPPSWRTPKWNHHGLWDWKARDVLLQTTGFFNSRRHPEWFDQGQAVADNTQTGFDTDDTDNKKTRLSKGSWLRQAGPDRPPVWSVLRQHWQPHLVRASAFGVWDLFVLIN

SEQ ID NO: 314 - protein, 149 aa, Mycoplasma pneumoniae
MFGLKVKNAEADTAKSNEKLQGAEATGSSTTSGSGQSTQRGGSSGDTKVKALQVAVKKKSGSQGNSGDQGTEQVELESNDLANAPIKRGSNPASPTQGSRLRHHPIQFGIWSIRHPHPLKAVACDRANSQGPPQMIRLDPHSVRCALCL

SEQ ID NO: 315 - protein, 270 aa, Mycoplasma pneumoniae
MFGLKVKDATVDSSKQSTESLKGEESSSSSTTSSTSTTQRGGSSGDTKVKALQVAVKKKSDSEDNGQIELETNNLANAPIKRGSNNNQQVQLKADDFGTSPSSSESGQSGTPTPWTPWLATEQIHKDLPKWSASILILYDAPYARNRTAIDRVDHLDPKVMTANYPPSWRTPKWNHHGLWDWKARDVLVQTTGFFNPRRHPDWFDQGQAVAENTQTGFDTDDTDNKKQGFRKQGEQSPAPIALPFEAYFANIGNLTWFGQALLVFGICLS

SEQ ID NO: 316 - protein, 313 aa, Mycoplasma pneumoniae
MGSQNQGSTTTTSAGNPDSLVTDKVDQKGQVQTSGQNLSDTNYTNLSPNFTPTSDWPNALSFTNKNNAQRAQLFLHGLLGSIPVLVNKSGENNEKFQATDQKWSYTELKSDQTKLNLPAYGEVNGLLNPALVETYFGTTRTSSTANQNSTTVPGIGFKIPEQNNDSKAVLITPGLAWTPQDVGNLVVSGTSFSFQLGGWLVSFTDFVKPRAGYLGLQLTGLDASDATQRALIWAPPALSGLSWQLGQPVGPRGECVGFEGGVGGSSSVRLARIYHHRNRGYLTGAPECFGLSGECGGSECLQAKHELRPNPIH

SEQ ID NO: 317 - protein, 129 aa, Mycoplasma pneumoniae
MSFGLVGTVNNNGWKSPFRHETKYRAGYDKFKYYKTHYRGAKKAGTNDDRWRWTAWFDLDFAHQKIVLIERGELHRQADLKKSDPATNETSKTVWGSIKEKLLQNVNNLHSEKGVFLWFRQSGFTTTRN

SEQ ID NO: 318 - protein, 280 aa, Mycobacterium tuberculosis H37Rv
MAEPLAVDPTGLSAAAAKLAGLVFPQPPAPIAVSGTDSVVAAINETMPSIESLVSDGLPGVKAALTRTASNMNAAADVYAKTDQSLGTSLSQYAFGSSGEGLAGVASVGGQPSQATQLLSTPVSQVTTQLGETAAELAPRVVATVPQLVQLAPHAVQMSQNASPIAQTISQTAQQAAQSAQGGSGPMPAQLASAEKPATEQAEPVHEVTNDDQGDQGDVQPAEVVAAARDEGAGASPGQQPGGGVPAQAMDTGAGARPAASPLAAPVDPSTPAPSTTTTL

SEQ ID NO: 319 - protein, 227 aa, Mycobacterium tuberculosis H37Rv
MRYLIATAVLVAVVLVGWPAAGAPPSCAGLGGTVQAGQICHVHASGPKYMLDMTFPVDYPDQQALTDYITQNRDGFVNVAQGSPLRDQPYQMDATSEQHSSGQPPQATRSVVLKFFQDLGGAHPSTWYKAFNYNLATSQPITFDTLFVPGTTPLDSIYPIVQRELARQTGFGAAILPSTGLDPAHYQNFAITDDSLIFYFAQGELLPSFVGACQAQVPRSAIPPLAI

SEQ ID NO: 320 - protein, 168 aa, Mycobacterium tuberculosis H37Rv
MKMVKSIAAGLTAAAAIGAAAAGVTSIMAGGPVVYQMQPVVFGAPLPLDPASAPDVPTAAQLTSLLNSLADPNVSFANKGSLVEGGIGGTEARIADHKLKKAAEHGDLPLSFSVTNIQPAAAGSATADVSVSGPKLSSPVTQNVTFVNQGGWMLSRASAMELLQAAGN

SEQ ID NO: 321 - protein, 303 aa, Mycobacterium tuberculosis H37Rv
MTYSPGNPGYPQAQPAGSYGGVTPSFAHADEGASKLPMYLNIAVAVLGLAAYFASFGPMFTLSTELGGGDGAVSGDTGLPVGVALLAALLAGVALVPKAKSHVTVVAVLGVLGVFLMVSATFNKPSAYSTGWALWVVLAFIVFQAVAAVLALLVETGAITAPAPRPKFDPYGQYGRYGQYGQYGVQPGGYYGQQGAQQAAGLQSPGPQQSPQPPGYGSQYGGYSSSPSQSGSGYTAQPPAQPPAQSGSQQSHQGPSTPPTGFPSFSPPPPVSAGTGSQAGSAPVNYSNPSGGEQSSSPGGAPV

SEQ ID NO: 322 - protein, 404 aa, Mycobacterium tuberculosis H37Rv
MKCPGVSDCVATVRHDNVFAIAAGLRWSAAVPPLHKGDAVTKLLVGAIAGGMLACAAILGDGIASADTALIVPGTAPSPYGPLRSLYHFNPAMQPQIGANYYNPTATRHVVSYPGSFWPVTGLNSPTVGSSVSAGTNNLDAAIRSTDGPIFVAGLSQGTLVLDREQARLANDPTAPPPGQLTFIKAGDPNNLLWRAFRPGTHVPIIDYTVPAPAESQYDTINIVGQYDIFSDPPNRPGNLLADLNAIAAGGYYGHSATAFSDPARVAPRDITTTTNSLGATTTTYFIRTDQLPLVRALVDMAGLPPQAAGTVDAALRPIIDRAYQPGPAPAVNPRDLVQGIRGIPAIAPAIAIPIGSTTGASAATSTAAATAAATNALRGANVGPGANKALSMVRGLLPKGKKH

SEQ ID NO: 323 - protein, 244 aa, Mycobacterium tuberculosis H37Rv
MSLLPTLQSFLPPPFDAIPNPIEDLDVLVAAAVAVAAGSLGVSAAQLGEIYRHDVVDEAQKAPHCPAESDQTPAGAAGDGDLPEVGGRVTSPPQPPVAALTGYSANIGGLSVPHSWNLPPAVRQVAAMFPGATPMYMTGSSDGSYAGLAAAGLAGTGLAGLAARGGSAPTPAAAAPAGAGGAGPAATRPAAQQTPAVPAAAAGSAIPGLPPGLPPGVVANLAATLAAIPGATIIVVPPSPNANQ

SEQ ID NO: 324 - protein, 548 aa, Mycobacterium tuberculosis H37Rv
MDVALGVAVTDRVARLALVDSAAPGTVIDQFVLDVAEHPVEVLTETVVGTDRSLAGENHRLVATRLCWPDQAKADELQHALQDSGVHDVAVISEAQAATALVGAAHAGSAVLLVGDETATLSVVGDPDAPPTMVAVAPVAGADATSTVDTLMARLGDQALAPGDVFLVGRSAEHTTVLADQLRAASTMRVQTPDDPTFALARGAAMAAGAATMAHPALVADATTSLPRAEAGQSGSEGEQLAYSQASDYELLPVDEYEEHDEYGAAADRSAPLSRRSLLIGNAVVAFAVIGFASLAVAVAVTIRPTAASKPVEGHQNAQPGKFMPLLPTQQQAPVPPPPPDDPTAGFQGGTIPAVQNVVPRPGTSPGVGGTPASPAPEAPAVPGVVPAPVPIPVPIIIPPFPGWQPGMPTIPTAPPTTPVTTSATTPPTTPPTTPVTTPPTTPPTTPVTTPPTTPPTTPVTTPPTTVAPTTVAPTTVAPTTVAPTTVAPATATPTTVAPQPTQQPTQQPTQQMPTQQQTVAPQTVAPAPQPPSGGRNGSGGGDLFGGF

SEQ ID NO: 325 - protein, 172 aa, Mycobacterium tuberculosis H37Rv
MKNARTTLIAAAIAGTLVTTSPAGIANADDAGLDPNAAAGPDAVGFDPNLPPAPDAAPVDTPPAPEDAGFDPNLPPPLAPDFLSPPAEEAPPVPVAYSVNWDAIAQCESGGNWSINTGNGYYGGLRFTAGTWRANGGSGSAANASREEQIRVAENVLRSQGIRAWPVCGRRG

SEQ ID NO: 326 - protein, 176 aa, Mycobacterium tuberculosis H37Rv
MTRLIPGCTLVGLMLTLLPAPTSAAGSNTATTLFPVDEVTQLETHTFLDCHPNGSCDFVAGANLRTPDGPTGFPPGLWARQTTEIRSTNRLAYLDAHATSQFERVMKAGGSDVITTVYFGEGPPDKYQTTGVIDSTNWSTGQPMTDVNVIVCTHMQVVYPGVNLTSPSTCAQANFS

SEQ ID NO: 327 - protein, 154 aa, Mycobacterium tuberculosis H37Rv
MTPGLLTTAGAGRPRDRCARIVCTVFIETAVVATMFVALLGLSTISSKADDIDWDAIAQCESGGNWAANTGNGLYGGLQISQATWDSNGGVGSPAAASPQQQIEVADNIMKTQGPGAWPKCSSCSQGDAPLGSLTHILTFLAAETGGCSGSRDD

SEQ ID NO: 328 - protein, 210 aa, Mycobacterium tuberculosis H37Rv
MMQQAVSGITGALGGAVGGVMGPLTQLPQQAMQAGQGAMQPLMSALQQTYGAEGLDVADGARLVDSIEGEPGLGGEPGAGDVGAGGGGGGTTPTGYLGPPPVPTSSPPTTPAGAPAKSVTPDPVSGTPRASGPAGMTGMPMVPPGALGAGAEGANKDKPVEKRVTGCAEWSTGQGPLNSTAECSGEICRRQAGGHQVDATDPCCAERRQG

SEQ ID NO: 329 - protein, 135 aa, Mycobacterium tuberculosis H37Rv
MIRELVTTAAITGAAIGGAPVAGADPQRYDGDVPGMNYDASLGAPCSSWERFIFGRGPSGQAEACHFPPPNQFPPAETGYWVISYPLYGVQQVGAPCPKPQAAAQSPDGLPMLCLGARGWQPGWFTGAGFFPPEP

SEQ ID NO: 330 - protein, 275 aa, Mycobacterium tuberculosis H37Rv
MKTTGTTIKLGIVWLVLSVFTVMIIVVFGQVRFHHTTGYSAVFTHVSGLRAGQFVRAAGVEVGKVAKVTLIDGDKQVLVDFTVDRSLSLDQATTASIRYLNLIGDRYLELGRGHSGQRLAPGATIPLEHTHPALDLDALLGGFRPLFQTLDPDKVNSIASSIITVFQGQGATINDILDQTASLTATLADRDHAIGEVVNNLNTVLATTVKHQTEFDRTVDKLEVLITGLKNRADPLAAAAAHISSAAGTLADLLGRIVHCCTAASGTSRASSSRS

SEQ ID NO: 331 - protein, 217 aa, Mycobacterium tuberculosis H37Rv
MTPRSLVRIVGVVVATTLALVSAPAGGRAAHADPCSDIAVVFARGTHQASGLGDVGEAFVDSLTSQVGGRSIGVYAVNYPASDDYRASASNGSDDASAHIQRTVASCPNTRIVLGGYSQGATVIDLSTSAMPPAVADHVAAVALFGEPSSGFSSMLWGGGSLPTIGPLYSSKTINLCAPDDPICTGGGNIMAHVSYVQSGMTSQAATFAANRLDHAG

SEQ ID NO: 332 - protein, 232 aa, Mycobacterium tuberculosis H37Rv
MISTTRIDFLWILSVAFASMIALATLLTLINQVVGTPYIPGGDSPAGTDCSELASWVSNAATARPVFGDRFNTGNEEAALAARGFQQGTAPNALVIGWNGHHTAVTLPDGTPVSSGEGGGVRVGGGGAYQPKFTHHMYLPMDVDAGEDQPPAPDEPVTAVDDVEPEMPAPCPTQRPPVTPRHNLCNKLRTMPGALSAALAAAAPVWPAPISGCRGFSTSLLAKRNHPVIVGK

SEQ ID NO: 333 - protein, 124 aa, Mycobacterium tuberculosis H37Rv
MTTMITLRRRFAVAVAGVATAAATTVTLAPAPANAADVYGAIAYSGNGSWGRSWDYPTRAAAEATAVKSCGYSDCKVLTSFTACGAVAANDRAYQGGVGPTLAAAMKDALTKLGGGYIDTWACN

SEQ ID NO: 334 - protein, 142 aa, Mycobacterium tuberculosis H37Rv
MAGLNIYVRRWRTALHATVSALIVAILGLAITPVASAATARATLSVTSTWQTGFIARFTITNSSTAPLTDWKLEFDLPAGESVLHTWNSTVARSGTHYVLSPANWNRIIAPGGSATGGLRGGLTGSYSPPSSCLLNGQYPCT

SEQ ID NO: 335 - protein, 516 aa, Mycobacterium tuberculosis H37Rv
MLTRAIKTQLVLLTVLAVIAVVVLGWYFLRIPSLVGIGRYTLYAELPRSGGLYRTANVTYRGITIGKVTGVEPTERGARATMSIDNGYQIPTDASANVHSVSAVGEQFVDLVSTRTSGPYLRHGQTITTTTVPSQIGPALDAANRGLAVLPKDRVASVLHEASEAVGGLGSSLNRLIEATQAIAHDVRGSLEDIDDIIERSAPIIDSQVNSGNEIARWAANLNTLAAQTAQTDPAVRSILANAAPTADQVNATFSDVRESLPQTLANLEVVIDMLKRYHNGVEQALVFLPQSGAIAQSVTTEFPGQAGLGVGGLALNQPPPCLTGFLPASEWRSPADTSTAPLPKGTYCRIPMDASNVVRGARNNPCVDVPGKRAATPRECRSNEAYVPGGTNPWYGDPNQMLSCPAPAARCDQPVKPGQVIPAPSVNNGINPLPADQLPGTPPPVNDPLQRPGSGTVQCNGQQPNPCVYTPSTFPTTIYDVQSGKVVAPDGVVYSVEASTHAGADGWKVMLAPTG

SEQ ID NO: 336 - protein, 159 aa, Rickettsia prowazekii
MLNNTQFLNLMKSYMKPEFYMSSIKNTTNLDLSSITNTIQKAMNIFFTTNKISTESMQSLFKKNSEIIQNNINTILNSTKEVINSKDFKQATEYHQKCVKSIYETSMDNAKELANIAYEASNKIFEAANKHITKNIHNASNNIHNTAEQVQKNFNNKSA

SEQ ID NO: 337 - protein, 163 aa, Rickettsia prowazekii
MNIKLVTYFLILVSSLKVNADLNHIQDSFKYQEAEQLTIELPWNDCTAIHKFLEEKLFFSEQQIKKENKIHEKYKQFYLQHNNKLSDFSMQFLEKKSEINSVETLISGFLKFCEDNFQTSKSKSHSLNFFQKQQDQWLHNIRNENYKTYYKKKYEDNTFRNIN

SEQ ID NO: 338 - protein, 222 aa, Rickettsia prowazekii
MKKLLLIATASATILSSSVSFAECIDNEWYLRADAGVAMFNKEQDKATGVKLKSNKAIPIDLGIGYYISENVRADLTLGTTIGGKLKKYGAATNTHFTGTNVSVSHKPTVTRLLINGYVDLTSFDMFDVFVGGGVGPALVKEKISGVSGLASNTKNKTNVSYKLIFGTSAQIADGVKVELAYSWINDGKTKTHNVMYKGASVQTGGMRYQSHNLTVGVRFGI

SEQ ID NO: 339 - protein, 588 aa, Rickettsia prowazekii
MKKNMRKQMLKIISIIIISLLLSSCSESTRDENGLLTDSQSTIIRDYIISQNSKNLKVNLKEKFGSNLKGVKLIGIKLTNEDLSGIDFTSCEILRTDFMGSNLEKAILTNSVIQESNFADSVIKNISGYNADFQGSIFNNITLQNTNFVQSNFSDTAFNKSTIINVNFENSKFSNVLWCHSNIDSSNFQKTHLKNNSFKNTNVMNSIFYGADLGKSVINNTNFTNNYFESSDLSNTKFTSVIIKDSNFTQSIFNSVNFNNIQSNNSFFSYTSFEDSTLHNIHLTKCDLQNSTINSSVFNNFKIDNAILTNMSLNDNTFNNLSIKNSNTNFVRINKSKGFNITLLNTNYSNAIFSNNDLKEFKVINTDLNNSEIINSNFTNGQFNNVNFSQSLIQNVNFTDVKITLGNLNQVALINSNLINTNIINSVLSNSQINNINYQAYYSFINTNVSNNIVINDNSNQIPPNNIVINSEKDLQNISNLANMNLTNFNLSNLVFNGVDFSKSIFKKANLTNTVIKNSILKDANFSAAILTKTDFSKSILTGSIFKFAQIDQTCFSNSDLTNTDFTEATIKNTAFDNANTHGIKGLE

SEQ ID NO: 340 - protein, 1294 aa, Porphyromonas gingivalis W83
MIQKFTNVKLNDMRKILSFLMMCSLHLGLQSQTWHGDPDSVAALPSIGIQESSCTRITFEVVFPGFYSVEKREGNQVFQRISMPGCGSFGNLGEAELPVLKKMIAVPEFSTANVAVKIKETETFDNYNIYPNPTYVVEELPEGGTYLVEAFAINNDYYSQNVSLPSTHYVYSQDGYFRSQRFIEVTLYPFRYNPVRQEILFAKKIEVTITFDNPQPPLQKNTGIFNKVASSAFINYEADGKSAIENDMVFSRGTTTYISGNVASNLPQNCDYLVIYDDMFNVNQQPHDEIKRLCEHRAFYNGFDVAAVSIKDVLNSFPSNATSYINETKLKNFIRSVYNQSNAKRTLDGKLGYVLLIGKPLSKYLADTDNTKVPTSFIHNVSLIPSHPTFGSICASDYFFSCVSPLDTVGDLFIGRFSVTNAHELHNLIEKTINKEISYNPIAHKNILYAEGKGCDAPILRLFLKEIASGYTVNSILKSNQVSAIDSIFDCLNNGSHHFYFNTHGMPTVWGIGQGLDVNTLTARLNNTSSQGLCTSLSCSSAVADSTIRSLGEVLTTYAPNKGFSAFLGGSRATQYAVYLEGPCPPSEFYEYLPYSLYHNLSTVVGEMLLSSIINTNSVDTYSKFNFNLLGDPALNIMAHGMEVSNCITLPNNTIISSPITIKNGGCLKIPEKGVLHFTNNGSIQVMSGGTLEIGNQAKISGETGANPTFITVYGDGLAINKQVEIDNIDRLNLFSTHSVMPKFHFDSVKFNSAPLYTTNCIVEISNCEFTNRSDIISKNCDLSVENSMFSSSGITVFKPMATSSITGLSTKAKITDNTFFATGNFAYHITNTPGLTATSNAAIKLDNIPEYYISGNKIVNCDEALVLNNSGNRTNRLHNITRNVIKNCRIGSTLYNSYGIYNRNKISNNHIGVRLLNNSCFYFDNAPVINEEDKQTFISNRTWQLYSSNGTFPLNFHYNSLQGGDTDTWIYNDTYTNRYIDVSNNHWGNNDLFDPNQVFNTPDLFIWIPFWDGLPNGRSGNSSAEAVEFQTALDCIGNSDYLSAKVALKMMVETYPESDFAIAALKELFRIEKMSGNDYEGLKDYFRSNPTIISSQNLFPTADFLSARCDIVCENYQSAIDWYENRLNSEISYQDSVFAVIDLGDIYWNMQLDSLRGTGIDLNILSCEQRKSLESHQNVKNYLLSTLPESTGTLLPPLECNKSSLDKSKIISISPNPAKAVVTIIYYTDNPSCSVIKIYGINGASADITGLPKHLSEGYYSIQFNTSNFDPGFYLVTLNVDQKIIDTEKLRIK

SEQ ID NO: 341 - protein, 773 aa, Shigella flexneri 2a str. 2457T
MQGKNTIVTTGDYSIGLLSQTSGNLNTDTIIRVNSDGSVTPSFSDGDDTFIVTAGNHAVGVLACASPGSACACVSSLDEESTADTGSNENNAIAKLDMAKGEITTHGTESYAAYANGTVVKAGDTLDYTNASVTLTDVDITTHGDNAHAIAARQGTVSFNQGEIYTTGPDAAIAKIYNGGTVTLKNTSAVAHQGSGIVLESSINGQEATVDILSGSSLRSANEILYHKDETSNVTITDSEVSSAADVFINNIKGHLTVDATNSKITGSANISTDDNTHTYLSLSDNSTWDIKADSTVSNLTVDNSTVYISRADGRDVEPTRLTITENYVGNNGVLHLRTELDDDNSATDKVVINGNTSGTTRVKVTNAGGSGAYTLNGIEIISVEGESNGEFIKDSRIFAGAYEYSLTRGNTEATNKNWYLTNFQATSGGETNSGGSSAPTVAPTPVLRPEAGSYVANLAAANTLFVMRLNDRAGETRYIDPVTEQERSSRLWLRQIGGHNAWRDSNGQLRTTSHRYVSQLGGDLLTGGFTDSDSWRLGVMAGYARDYNLTHSSVSDYRSKGSVRGYSAGLYATWFADDISKKGAYIDSWAQYSWFKNSVKGDELAYESYSAKGATVSLEAGYGFALNKSFGLEAAKYTWIFQPQAQAIWMGVDHNAHTEANGSRIENDANNNIQTRLGFRTFIRTQEKNSGPHGDDFEPFVEMNWIHNSKDFAVSMNGVKVEQDGVSNLGEIKLGVNGNLNPAASVWGNVGVQLGDNGYNDTAVMVGLKYKF

SEQ ID NO: 342 - protein, 248 aa, Shigella flexneri 2a str. 2457T
MTKLKLLALGVLIATSAGVAHAEGKFSLGAGVGVVEHPYKDYDTDVYPVPVINYEGDNFWFRGLGGGYYLWNDATDKLSITAYWSPLYFKAKDSGDHQMRHLDDRKSTMMAGLSYAHFTQYGYLRTTLAGDTLDNSNGIVWDMAWLYRYTNGGLTVTPGIGVQWNSENQNEYYYGVSRKESARSGLRGYNPNDSWSPYLELSASYNFLGDWSVYGTARYTRLSDEVTDSPMVDKSWTGLISTGITYKF

SEQ ID NO: 343 - protein, 180 aa, Shigella flexneri 2a str. 2457T
MKKIALAGLAGMLLVSASVNAMSISGQAGKEYTNIGVGFGTESTGLALSGNWTHNDDDGDVAGVGLGLNLPLGPLMATVGGKGVYTNPNYGDEGYAAAVGGGLQWKIGNSFRLFGEYYYSPDSLSSGIQSYEEANAGARYTIMRPVSIEAGYRYLNLSGKDGNRDNAVADGLYVGVNASF

SEQ ID NO: 344 - protein, 404 aa, Shigella flexneri 2a str. 2457T
MTTLTARVFTTAEIIYRKTVIALVCHLNCSRQETVTMNKTIMALAIMMASFAANASVLPETPVPFKSGTGAIDNDTVYIGLGSAGTAWYKLDTQAKDKKWTALAAFPGGPREQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLDPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 345 - protein, 162 aa, Shigella flexneri 2a str. 2457T
MATGGAALAGKAVMGAAAGAAGGASALQAAFQKASASMETGGDMSSMGSVVSSGGNGGGEAGTAGSSPFAQAAGFGDSGSSSSGGGFAKAAKLATGTASELAKGVGSQVKQGFQERVSETTGGKLAASIRESMEPKEASQSGQFEGNSLGADSGPDSNEVRS

SEQ ID NO: 346 - protein, 786 aa, Shigella flexneri 2a str. 2457T
MKRVLIPGVILCGADVAQAVDDKNMYMYFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRLDWLTSHIDENNKSAFNQGSSGSTYFSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGDVSHQPYFGAEYIYSDAWTERHNQSESYVINAAGKKTNHTIYHKGKGSLGIDNYTLYMADHISWRNVSLMPGVRYDYDNYLSNHNISPRFMTEWDIFADQTSMITAGYNRYYGGNILDMGLRDIRNSWTESVSGNKTLTRYQNLKTPYNDELAMGLQQKIDKNVIARASEAHDQISKSSRTDSATKTTITEYNNDGKTKTHSFNLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 347 - protein, 170 aa, Shigella flexneri 2a str. 2457T
MKKTLLAIMLAGTAFASQAGTLVSQGTEASANLTLTKPIVVNNTIQPVKGVYSGTLTAWTPLATGIVGASDGQSHDYAVTFPDDIYAESSTSADAVISGDNNPDHKLKVSLTTLEQDPPSAASEEIGGKRYMMLKNTGTGGAYRVVSHMKEQVVEPDSYTIRTQAYIYAE

SEQ ID NO: 348 - protein, 234 aa, Shigella flexneri 2a str. 2457T
MGIYHWSRKTKMKRTKSIRHASFRKNWSARHLTPVALAVATVFMLAGCEKSDETVSLYQNADDCSAANPGKSAECTTAYNNALKEAERTAPKYATREDCVAEFGEGQCQQAPAQAGMAPENQAQAQQSSGSFWMPLMAGYMMGRLMGGGAGFAQQPLFSSKNPASPAYGKYTDATGKNYGAAQPGRTMTVPKTAMAPKPATTTTVTRGGFGESVAKQSTMQRSATGTSSRSMGG

SEQ ID NO: 349 - protein, 213 aa, Shigella flexneri 2a str. 2457T
MTKMSRYALITALAMFLAGCVGQREPAPVEEVKPAPEQPAEPQQPVPTVPSVPTIPQQPGPIEHEDRTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSCASGNVNAPTLQMQLMLVQTGEIIWSGKGAVSQQ

SEQ ID NO: 350 - protein, 171 aa, Shigella flexneri 2a str. 2457T
MTKLMQFVQRCYYMTNKKMYFILILVFTLLQVCFFALWKARDGSTTSLECTSTLTRNAKTDHSLYYSANLSVILKKDGSGSFTIVGLTDEDTPRKFSHSYFFTYKIDSNGRISGNAKAKVSGLENQIKDENFRLNFLDASLTGKGNARLSKFNNVYIFSIPGLIINTCAPI

SEQ ID NO: 351 - protein, 157 aa, Shigella flexneri 2a str. 2457T
MGRISSGGMMFKAITTVAALVIATSAMAQDDLTISSLAKGETTKAAFNQMVQGHKLPAWVMKGGTYTPAQTVTLGDETYQVMSACKPHDCGSQRIAVMWSEKSNQMTGLFSAIDEKTSQEKLTWLNVNDALSIDGKTVLFAALTGSLENHPDGFNFK

SEQ ID NO: 352 - protein, 211 aa, Streptococcus mutans UA159
MKKQFLEKAVFTVAATAATVVLGNKMADADTYTLQEGDSFFSVAQRYHMDAYELASMNGKDITSLILPGQTLTVNGSAAPDNQAAAPTDTTQATTETNDANANTYPVGQCTWGVKAVATWAGDWWGNGGDWASSASAQGYTVGNTPAVGSIMCWTDGGYGHVAYVTAVGEDGKVQVLESNYKDQQWVDNYRGWFDPNNSGTPGSVSYIYPN

SEQ ID NO: 353 - protein, 288 aa, Streptococcus mutans UA159
MSIKNILENKTTTIKVSFAGIATAASLILPMAVQAETTYTVKSGDTLSEIASTHGTTVDKLAKLNKINNIHLIHAGQILELDAATEDTDATPVQESQINEAETSASAKTSQTSEVTTTAPVQESQTSEVITSAPAETSQTSEVPTEANQTNEVSSAVSVETSQTSEATTSAPVETSQTSEATTAEPTETKTSQTNEVAASAEENQTTSNTSGLSTSDAAAKEFIAQKESGGNYNAKNGQYYGRYQLSDSYLNGDLSEENQERVADAYVSSRYGSWTAAQAFWNANGWY

SEQ ID NO: 354 - protein, 117 aa, Streptococcus mutans UA159
MKCQAFEDFKATSLNKLSYTTGGATDGEIIANRMLQGKATKGEITMYTWNIIQNGWVNSLVSWGIGGYNSSIGYSAQGNRGFSNYPYDVSMDSDNSSSSSNTTGGYVNYNQSFNSGW

SEQ ID NO: 355 - protein, 518 aa, Streptococcus mutans UA159
MRYSQICRKSLALLATGMILTTSTLPSISILAEDSTGAPARPDGQAPAGGGANTTTYDYSGINSGVLVANGSKVTSSSKTKSTTSAQNTALVQNGGSLTLHKANLIKSGDDNNGDNDNFYGINSILLAVNERSKAYVSNSKLKASSSGSNGIFATDKATIYANKTSIATTADNSRGLDATYNGNIIANKMAISTKGAHSAAIATDRGGGNISTTNSSLNTSGSGSPLLYSTGNIQVNHVTGTSSNSQIAGMEGLNTILIHNSNLISTMTNKTASDPIANGVIIYQSQSGDAEATTGQSAHFELSKSKLTSSITSGSMFYLTNTSANIILNQSTLNFDANKAKLLTVAGNSANNWGTPGSNGATVNFTGHKQTLKGDVDVDSISTLNMYLLDKTNYTGKTAVSTNSTNISPSTSPITMNISKNSKWVLTGHSTVTNLNAEKGAKIVDKDGKTVSVISSSGQKLVKGKSKYSLTVTGTYSQKVTTSSSNKPSSSYINRSDFDNYFKTTTAFVNNTKNTSN

SEQ ID NO: 356 - protein, 325 aa, Streptococcus mutans UA159
MNKIGDTLRDARIEKKLSFDDVVDKTGIAPHYILAMELDQLKLLPEGKTNEYLEKYAHAVGLDPVSIIHGYRNQEMSDELILPSSAELAASSDSNIEKKNEGKSIEEPQELAIDSLDVTQNITEETPQIEDFKVESEEASKKIEKIPSRLSKYDYDEEPKKKFPWALILLILLALTIISYVGYVVYNQLQTDSNKTELSTSTKKSKDTKNDANSTTQSQTSITTDFADGGNNITLSNTNGKVEVTFTLTGDEESWVSATNTTDGESGTTLTATDKTYTVTLAEGSTTSMLTVGSPSGVEITINGQKVDTTNLVNAGLTNINLTVQ

SEQ ID NO: 357 - protein, 506 aa, Streptococcus mutans UA159
MKSRKRQRKGLVRKNEIIILTLFVASAVSLLAFTNSFGVLAKSLHLEKINKSITISLPFGKKKMEQTARYYSGEQVQISSSAKKDSLGKGLSHYQNWIGTVKKIKSQKDSRQKHHYSYEVTFDNGKALKYVQEKDLVKTKRSKYSKGQIVKLKSSATADLDGSSLTDYRASAGKIDHISYNHSNTTGGYKYDITFDEGGKVTNIQEKDLDKVYEVQLKSENTAAQNNEILKQAFAYAKQHSGTILSLPNGEFKIGSQTPDKDYITLTSDTEIRGDNTTLLVEGSAYWFAFATGTSASDGVKNFTMRNINIKASDLEKGNQFMIMADHGDNWKICNNSFTMVHKKGSHIFDLGSLQNSAFEGNQFTGYAPELTNVSKIDDNADLHDFYSEVIQLDAAESSGVWDGGLIKAIDPNYENYNKEKQLCNNITIANNSFVPYIDSHGKIIAYSGTIGQHSSDVGLVKIYDNVFSNSLVSRFNQNGKSEAWIFKAIHLKSNYNNAVYANSIS

SEQ ID NO: 358 - protein, 544 aa, Streptococcus mutans UA159
MRKLKVALFASSILGMLAVSSYTAADTEDNQVTISHYNEQAGTFDVNAVQAANGKTIQSIDVAIWSEENGQDDLKWYHASNDGSNQLTVHFNAENHGSKVGSYIAHAYITYTDGNRVGVNLGKRKLSLSAPQLSLKQGGLQLFSKLKPSAADQLFSAVWSDENGQDDLHWYTADADGNTLAGYANHKGYGTYHVHTYLKQNGKMIPISAQDIDIPKPKVKIQIDKINDTSYDVVVNNVPPYISSVAIPVWSEQNGQDDLKWYQATKVADGIFKTTVYLKTHRFELGNYQAHIYGDSQLSKKLDGLGETHFNVPSIINYEDPQVTIDHYNINKGTFDVTVAETDNSKAIQSISAAVWSDANQANLYWYEAKQLANGKAAITVDVQKHGNQTGSYNVHVYVHYNDGTTSGHVLANQQLNQIVHYQPSAVRITAYMNEKNTYPVGQCTWGVKELAPWIPNWLGNGGQWASTVAVKGFKIGTVPKVGAIACWSDGGYGHVAYVTHVESNNRIQVKEANYKNQQYISNFRGWFDPTTSYLGRLTYIYPD

SEQ ID NO: 359 - protein, 148 aa, Streptococcus mutans UA159
MANNYSRRQQPTKKTKGTSRKRPTEHIKTGFSALQKSVAIIAGILGIITALITINNYRNSSHNDKKDSTSKTTIIKEKEVDDSNSNNNAANSQAENDSNNNNNSAESNQNQTATTANDSNSNSANQNQANSQSQANNQQNQNNANAGQ

SEQ ID NO: 360 - protein, 106 aa, Streptococcus mutans UA159
MKIFSFGTIRNNTALKPNYDDTTAFSGFGTIRNNTALKQSTNCASWFNRFGTIRNNTALKLTILINGVSFCFGTIRNNTALKPRGPIFVSTFRNRAIHLSQISASK

SEQ ID NO: 361 - protein, 195 aa, Streptococcus mutans UA159
MKRKRNLYFLIGLFLTVFLLIGCSMQKKTKSESSSTSQKTTLQTKQSSEKSTDAKQTTEAHSESSQSSSHSNNEETLAPIDTGAVLKADYSSMAGTWKNEEGQTLTFDQRGLTTPGMTVSLLNIDQDGNLLLNVETGTKKNLTLYIVPANKTLSNQYFSNGQSDESDKTKDRIVSSESLNSGKFTNRVYYHVSTH

SEQ ID NO: 362 - protein, 211 aa, Streptococcus mutans UA159
MTPKKIKIALTALISLMLALFLFLFNHHSVRENSQQEKLKISKASSKKSQTSTSSVMTSSRKATEQTSQAQTQSQSQAEQSNPNVILPIPQELVGTYKGSSPQASEITFTISSNGQLRAQANFDPASDINDVTATVSGVRKVGADTYIWEFVSGSSAALLPGVTGIGGLGKMQPGFILKGGQLTPIMFTGSVDGEIDYSHPNPYPVSLNKQ

SEQ ID NO: 363 - protein, 129 aa, Streptococcus mutans UA159
MKKIINVIVLSLSVFFLIACSNSSTGEKTSQSSEETKVRLIVKTDSNKTDEKVAFKKGATVMDVLKDNYKVKESGGFITTIDGVTQDKKAGRYWMFDVNDKLASKAADKIKVKNGDKIEFYLKVYKGKN

SEQ ID NO: 364 - protein, 160 aa, Streptococcus mutans UA159
MSNKPWEEKVTDATTDNEEMTRNSKDASIISTPILTILLSLFFLIIIGILFFVLYTSNGGSNEKAATSGFYSSSKTVKKAKNEANSQTDEQTTEAETSSSETTSSSSDSDGETITVQGGEGAAAIAARAGISVDKLYELNPEHMTHGYWYANPGDNIKIK

SEQ ID NO: 365 - protein, 237 aa, Streptococcus mutans UA159
MPDNRMNYSIDSNMQFPLVEITLETGEFAYIQRGSMVYHTPSVTLNTKVNGRGSGLGKLVGAIGRSVTSGESFFITQAVSNASDGKLALAPSMPGQVIALELGEKQYRLNDGAFLALDGSAQYQMKAQSVGRALFGGQGGLFVMTTEGQGTLLANSFGSIKKIELQNQEITIDNAHVVAWSRDLNYDIHLENGFMQSIGTGEGVVNTFRGTGEIYVQSLNLQQFAGVLQGFITNTNR

SEQ ID NO: 366 - protein, 228 aa, Streptococcus mutans UA159
MKKNYFWYGLLGLLALYLITIAFIPGFHIFFSNMLMLALFFMLIALSNRSIFFFFLALGFLSIYLKDIFHFDYSTGPLFTGIIIIGVILNSFLKPHYSYSYKGNHYFNMKQHANYIDNETDVFLKTLFSENTSYVTSQELNKIIIDTKFGEQSVDLSQAQFMTDSPEIHIDVSFGETNLRIPNNWKIINKTHSPFASISFSGFPSTNGDFINVTLTGTVAMGSLNIQY

SEQ ID NO: 367 - protein, 167 aa, Streptococcus pneumoniae R6
MKSITKKIKATLAGVAALFAVFAPSFVSAQESSTYTVKEGDTLSEIAETHNTTVEKLAENNHIDNIHLIYVDQELVIDGPVAPVATPAPATYAAPAAQDETVSAPVAETPVVSETVVSTVSGSEAEAKEWIAQKESGGSYTATNGRYIGRYGSWTAAKNFWLNNGWY

SEQ ID NO: 368 - protein, 2551 aa, Streptococcus pneumoniae R6
MKHSHKKSFDWYSMQQRYSIRKYYFGAASVLLGTALVLGAAASVQTVQAEENKQETTNSISVGRGEAATKPAEVSASNKEKTYAAPTVANPVETTPVKTEEVTKPAEKVEEAKDKKEEVTHQDAVDKSKLLTALSRAKKLESKLYTEASAANLQTSIQAGQSLLGKADATEAELSAAESSIQSFIIGLELRSNSNKETVSETPVAKKADAVESKEGAKPAATTERSAVDSAILPTSTADKVETTSAPASINEILKLGLSLSDARQNPAIRKEDVNRGYSGFRAASNPANPIVSGSGNTVAFADISQGGRSYSFRGYGNSRGGNSIHYDVTTVRSGNSVNFTISYSAPGDSREFVNNNFILDKGDGFGNPSNATITSSNPRVREQSKSISQGANYVSHSGYSMTSAISTNTEQTIRFSLPIINLNGDLSVRLKPVTFNVDQGGGGAATSNDPYSNSNYYYRANPLYLDANPYGGTNNKTVSEDIDFQTVYLPTSKLPEGQTRLVREGEKGQRQITYKVHRFGNETLLGLPISNSVTKEAKPRIMQIGVAKDLIDTVKPRVDQNKVGDTNNLTFYLDNDGNGVYTEGVDELVQKIAIKDGAKGEKGDQGERGLTGAKGEKGDRGERGLTGAQGAKGEKGDRGERGLTGAQGAKGEKGDRGERGLTGAQGAKGEKGDRGERGLTGAQGAKGEKGAQGERGLTGAQGAKGEKGDQGERGLTGAQGAKGEKGDQGERGLTGAQGAKGEKGAQGERGLTGTQGAKGEKGDRGERGLTGAQGAKGEKGDRGERGLTGAQGAKGEKGAQGERGLTGAQGAKGEKGDQGERGLTGAQGEKGDRGERGLTGAKGEKGDQGERGITGAKGEKGAQGERGLTGAQGAKGEKGDQGERGLTGAQGEKGAQGQAGRDGVTPTVTVKDNKNDGTHTITINDGRGNVTSTVVRDGFDGASPLVATQRNDADKTTTVIFYYDKNGNNELDASDKKLKEVVIADGAKGEKGDKGEQGLQGRDGEQGPKGEDGKTPTVKVTDGQDGTHTITINDGKGGITTTVVRDGFDGASPLVSTHRNEADKTTTVIFYYDLNDNNQFDEGDTKLKEVVIADGKQGPKGDKGDNGKDGFTPEVTVTDNNNGTHTITITQPDNRPSLTTIVKNGEDGKTPKVKAERDDAKKQTTLTFYIDKDGDGSYTAGKDELVQTTVVKDGQDGAAGASGRDGKEVLNGKVDPTTEGKDGDTFVNTQTGDVFVKKGNTWEPAGNIKGPKGDKGADGAKGEKGAQGERGLTGAQGVKGEKGDQGERGLTGSKGEKGDQGERGLTGAQGAKGDKGEQGLQGRDGAQGPKGADGQRGPAGPQGPKGEQGNPGTPGKDGKSLIAVKNGVLVTITPVEGRPQTTFVEDGQKGADGKTPTVTITEGQNGTHTLTVHNPGSPDVTTTIRDGATGQAGRDGKDVLNGKVNPQPNQGKNGDKYINIETGDVYVKNNGNWDKEGNIKGPKGDKGADGAKGEKGDQGERGLTGAQGAKGADGAVGRDGRDGKDVLNGKANPEAHQGKDGDKYVNTETGDVFVKNNGNWDKEGNIKGPKGDKGADGAKGEKGDRGERGLTGAQGAKGADGAAGRDGRDGRDGKDVLNGKVNPEANQGKDGDKYVNTETGDVFVKNNGNWDKEGNIKGSKGDKGERGEDGKTPEVTVTPGKDGHSTDITFTVPGKDPVTVNVKDGENGLNGKTPKVDLLRVQGKNGNPSHTIVTFYTDENNDGKYTPGTDELLGSEMIKDGAKGADGRDGKSLLTVKDGKETKVYQEDPANPGQPLNPEKPLAVIRDGVDGKSPTVTAVRKDEAGHKGVEITVDNHDGSQPTTVFVQDGAKGKTGATGQDGQTPTITTQRGQDGQSTVVTITTSGKDPVTFTVKDGKNGKDGRAPKIKVEDITSPSRIRRDTDAAATPTRNGIRVTVYDDVNDNGVYDEGVDKVLNSKDIYNGIDGRDGSAPTITTKDNGDGTHTITVQNPDGSESTTVVKDGKDGKTANITTTENPDGSHTITVTNPDGSTKETVVKNGKDGKTPKVEVTDNNDGTHTVKVTDGDGNVTNAIIKDGKDGKAATATTTENPDGSHTVTITNPDGTKNEFVVKNGRDGVDGRTPTASVRDNGDGSHTIVITNPEGVTTETTVRDGKSPKVTITDEQNGTHKISVLNGDGTTTETIIKDGKSPVATVRDNQDGTYTIRVENGNGTVSETTVRDGKSPTAKVVDNGDGTHTITVVNSDGITTTTTVRDGREPKLEVIDNNDGSHTIKVTGADGKGTTTTIFDGKSPKANIVDNGDGTHTLTIVDSDGREYKSIIKDGKDGKDSVSPTVTVKNNNDGTHVVTITNPDGSKTEMVIKDGKDGKSPKVSVEDNGDGSHTITIINSDGTVTKTVIKDGKDGRDGRDGRDGKDGKDGKCGCQDKPVTPSNDKPVPPTPNVPTPEVPVKPVPAQPTPNVPTPEVPVQPTPAVSTPEVPVKPVPAVPEQPVVPTPAQPATPVNANPVAPTTGKENRGDKLPETGSQSDYISVLLGSGILLSLYVGRRKED

SEQ ID NO: 369 - protein, 380 aa, Streptococcus pneumoniae R6
MKKRMLLASTVALSFAPVLATQAEEVLWTARSVEQIQNDLTKTDNKTSYTVQYGDTLSTIAEALGVDVTVLANLNKITNMDLIFPETVLTTTVNEAEEVTEVEIQTPQADSSEEVTTATADLTTNQVTVDDQTVQVADLSQPIAEAPKEVASSSEVTKTVIASEEVAPSTGTSVPEEQTAETSSAVAEEAPQETTPAEKQETQTSPQAASAVEATTTSSEAKEVASSNGATAAVSTYQPEETKIISTTYEAPAAPDYAGLAVAKSENAGLQPQTAAFKEEIANLFGITSFSGYRPGDSGDHGKGLAIDFMVPERSELGDKIAEYAIQNMASRGISYIIWKQRFYAPFDSKYGPANTWNPMPDRGSVTENHYDHVHVSMNG

SEQ ID NO: 370 - protein, 221 aa, Streptococcus pneumoniae R6
MTILGKDTVQQSAKGESVTQEATPEYKLENTPGGDKGGNTGSSDANANEGGGSQAGGSAHTGSQNSAQSQASKQLATEKESAKNAIEKAAKNKQDEIKGAPLSDKEKAELLARVEAEKQAALKEIENAKTMEDVKEAETIGVQAIAMVTVPKRPVAPNAAPKTTSAPQATAGTMQDVTYQSPAGKQLPNTGSASSAALASLGLVVATSGFALLGRKTRRRK

SEQ ID NO: 371 - protein, 135 aa, Streptococcus pneumoniae R6
MMTTGCSMGAYHALNFFLQHPDVFTKVIALSGVYDARFFVGDYYNDDAIYQNSPVDYIWNQNDGWFIDRYRQAEIVLCTGLGAWEQDGLPSFYKLKEAFDKKQIPAWFAEWGHDVAHDWEWWRKQMPYFLGNLYL

SEQ ID NO: 372 - protein, 1767 aa, Streptococcus pneumoniae R6
MNKGLFEKRCKYSIRKFSLGVASVMIGATFFGTSPVLADSVQSGSTANLPADLATALATAKENDGHDFEAPKVGEDQGSPEVTDGPKTEEELLALEKEKPAEEKPKEDKPAAAKPETPKTVTPEWQTVEKKEQQGTVTIREEKGVRYNQLSSTAQNDNAGKPALFEKKGLTVDANGNATVDLTFKDDSEKGKSRFGVFLKFKDTKNNVFVGYDKDGWFWEYKSPTTSTWYRGSRVAAPETGSTNRLSITLKSDGQLNASNNDVNLFDTVTLPAAVNDHLKNEKKILLKAGSYDDERTVVSVKTDNQEGVKTEDTPAEKETGPEVDDSKVTYDTIQSKVLKAVIDQAFPRVKEYSLNGHTLPGQVQQFNQVFINNHRITPEVTYKKINETTAEYLMKLRDDAHLINAEMTVRLQVVDNQLHFDVTKIVNHNQVTPGQKIDDERKLLSSISFLGNALVSVSSDQTGAKFDGATMSNNTHVSGDDHIDVTNPMKDLAKGYMYGFVSTDKLAAGVWSNSQNSYGGGSNDWTRLTAYKETVGNANYVGIHSSEWQWEKAYKGIVFPEYTKELPSAKVVITEDANADKKVDWQDGAIAYRSIMNNPQGWKKVKDITAYRIAMNFGSQAQNPFLMTLDGIKKINLHTDGLGQGVLLKGYGSEGHDSGHLNYADIGKRIGGVEDFKTLIEKAKKYGAHLGIHVNASETYPESKYFNEKILRKNPDGSYSYGWNWLDQGINIDAAYDLAHGRLARWEDLKKKLGDGLDFIYVDVWGNGQSGDNGAWATHVLAKEINKQGWRFAIEWGHGGEYDSTFHHWAADLTYGGYTNKGINSAITRFIRNHQKDAWVGDYRSYGGAANYPLLGGYSMKDFEGWQGRSDYNGYVTNLFAHDVMTKYFQHFTVSKWENGTPVTMTDNGSTYKWTPEMRVELVDADNNKVVVTRKSNDVNSPQYRERTVTLNGRVIQDGSAYLTPWNWDANGKKLSTDKEKMYYFNTQAGATTWTLPSDWAKSKVYLYKLTDQGKTEEQELTVKDGKITLDLLANQPYVLYRSKQTNPEMSWSEGMHIYDQGFNSGTLKHWTISGDASKAEIVKSQGANDMLRIQGNKEKVSLTQKLTGLKPNTKYAVYVGVDNRSNAKASITVNTGEKEVTTYTNKSLALNYVKAYAHNTRRNNATVDDTSYFQNMYAFFTTGSDVSNVTLTLSREAGDEATYFDEIRTFENNSSMYGDKHDTGKGTFKQDFENVAQGIFPFVVGGVEGVEDNRTHLSEKHDPYTQRGWNGKKVDDVIEGNWSLKTNGLVSRRNLVYQTIPQNFRFEAGKTYRVTFEYEAGSDNTYAFVVGKGEFQSGRRGTQASNLEMHELPNTWTDSKKAKKATFLVTGAETGDTWVGIYSTGNASNTRGDSGGNANFRGYNDFMMDNLQIEEITLTGKMLTENALKNYLPTVAMTNYTKESMDALKEAVFNLSQADDDISVEEARAEIAKIEALKNALVQKKTALVADDFASLTAPAQAQEGLANAFDGNLSSLWHTSWGGGDVGKPATMVLKEATEITGLRYVPRGSGSNGNLRDVKLVVTDESGKEHTFTATDWPDNNKPKDIDFGKTIKAKKIVLTGTKTYGDGGDKYQSAAELIFTRPQVAETPLDLSGYEAALAKAQKLTDKDNQEEVASVQASMKYATDNHLLTERMVEYFADYLNQLKDSATKPDAPTVEKPEFKLSSVASDQGKTPDYKQEIARPETPEQILPATGESQFDTALFLASVSLALSALFVVKTKKD

SEQ ID NO: 373 - protein, 450 aa, Streptococcus pneumoniae R6
MKLYNKSELRYSRIFFDKRPPAFAFILIISTAIILSGALVGAAYIPKNYIVKANGNSVITGTEFLSAISSGKVVTLHKSEGDMVNAGDVIISLSSGQEGLQASSLNKQLVKLRAKEAIFQKFEQSLNEKYNRMSNSGEEQEYYGKVEYYLSQLNSENYNNGTQYSKIQDEYTKLNKITAERNQLDADLQTLQNELIQLQQQGDSPSLSDTTSADDKAKLETKILEITTKIEALKTNITSKNSEIDSQQSNIKDMNRTYNDPTSQAYNIYAQLVSELGTARSNNNKSITELEANLGVATGQDKAHSILAPNEGTLHYLVPLKQGMSIQQGQTIAEVSGKEKGYYVEAFVLASDISRVSKGAKVDVAITGVNSQKYGTLKGQVRQIDSGTISQETKEGNISLYKVMIELETLTLKHGSETVVLQKDMPVEVRIVYDKETYLDWILEMLSFKQ

SEQ ID NO: 374 - protein, 2015 aa, Neisseria meningitidis Z2491
MNKGLHRIIFSKKHSTMVAVAETANSQGKGKQAGSSVSVSLKTSGDLCGKLKTTLKTLVCSLVSLSMVLPAHAQITTDKSAPKNQQVVILKTNTGAPLVNIQTPNGRGLSHNRYTQFDVDNKGAVLNNDRNNNPFLVKGSAQLILNEVRGTASKLNGIVTVGGQKADVIIANPNGITVNGGGFKNVGRGILTIGAPQIGKDGALTGFDVRQGTLTVGAAGWNDKGGADYTGVLARAVALQGKLQGKNLAVSTGPQKVDYASGEISAGTAAGTKPTIALDTAALGGMYADSITLIANEKGVGVKNAGTLEAAKQLIVTSSGRIENSGRIATTADGTEASPTYLSIETTEKGAAGTFISNGGRIESKGLLVIETGEDISLRNGAVVQNNGSRPATTVLNAGHNLVIESKTNVNNAKGSANLSAGGRTTINDATIQAGSSVYSSTKGDTELGENTRIIAENVTVLSNGSIGSAAVIEAKDTAHIESGKPLSLETSTVASNIRLNNGNIKGGKQLALLADDNITAKTTNLNTPGNLYVHTGKDLNLNVDKDLSAASIHLKSDNAAHITGTSKTLTASKDMGVEAGLLNVTNTNLRTNSGNLHIQAAKGNIQLRNTKLNAAKALETTALQGNIVSDGLHAVSADGHVSLLANGNADFTGHNTLTAKADVNAGSVGKGRLKADNTNITSSSGDITLVAGNGIQLGDGKQRNSINGKHISIKNNGGNADLKNLNVHAKSGALNIHSDRALSIENTKLESTHNTHLNAQHERVTLNQVDAYAHRHLSITGSQIWQNDKLPSANKLVANGVLALNARYSQIADNTTLRAGAINLTAGTALVKRGNINWSTVSTKTLEDNAELKPLAGRLNIEAGSGTLTIEPANRISAHTDLSIKTGGKLLLSAKGGNAGAPSAQVSSLEAKGNIRLVTGETDLRGSKITAGKNLVVATTKGKLNIEAVNNSFSNYFPTQKAAELNQKSKELEQQIAQLKKSSPKSKLIPTLQEERDRLAFYIQAINKEVKGKKPKGKEYLQAKLSAQNIDLISAQGIEISGSDITASKKLNLHAAGVLPKAADSEAAAILIDGITDQYEIGKPTYKSHYDKAALNKPSRLTGRTGVSIHAAAALDDARIIIGASEIKAPSGSIDIKAHSDIVLEAGQNDAYTFLKTKGKSGKIIRKTKFTSTRDHLIMPAPVELTANGITLQAGGNIEANTTRFNAPAGKVTLVAGEELQLLAEEGIHKHELDVQKSRRFIGIKVGKSNYSKNELNETKLPVRVVAQTAATRSGWDTVLEGTEFKTTLAGADIQAGVGEKARVDAKIILKGIVNRIQSEEKLETNSTVWQKQAGRGSTIETLKLPSFESPTPPKLSAPGGYIVDIPKGNLKTEIEKLSKQPEYAYLKQLQVAKNINWNQVQLAYDRWDYKQEGLTEAGAAIIALAVTVVTSGAGTGAVLGLNGAAAAATDAAFASLASQASVSFINNKGDVGKTLKELGRSSTVKNLVVAAATAGVADKIGASALNNVSDKQWINNLTVNLANAGSAALINTAINGGSLKDNLGDAALGAIVSTVHGEVASKIKFNLSEDYITHKIAHAIAGCAAAAANKGKCQDGAIGAAVGEIVGEALTNGKNPATLTAKEREQILAYSKLVAGTVSGVVGGDVNTAANAAKVAIENNLLSQEEYALREKLIKKAKGKGLLSLDWGSLTEQEARQFIYLIEKDRYSNQLLDRYQKNPSSLNNQEKNILAYFINQTSGGNTAWAASILKTPQSMGNLTIPSKDINNTLSKAYQTLSRYDSFDYKSAVAAQPALYLLNGPLGFSVKAATVAAGGYNIGQGAKAISNGEYLHGTVQVVNGTLMVAGSVSAQAAISAKPAPVTRYLSNDSAPALRQALTAESQRIRMKLPEEYRQIGNLAIAKIDVKGLPQRMEAFSSFQKGEHGFISLPETKIFKPISVDKYHNIASPPRGTLRNIDGEYKLLETIAQQLGNNRNVSGRIDLFTELKACQSCSNVILEFRNRYPNIQLNIFTGK

SEQ ID NO: 375 - protein, 760 aa, Neisseria meningitidis Z2491
MDLIQTPNKQFVDGDRRTPGTPVPAWWLNQLQGELYSILNAVGIEPNKADHAQVLSAIKTLAADASQVASIDALRKYSGTGYVNVNAYHANTTVGGGVFVADKADKSTADNGCTVIVSTDGTRWKRVFSGMLNLHDFGYVASKNNALSTLNAAESAALDVVVDCLGLSIDTGNIYPQKNKYTNGKFVINGKTVDVQYQPIRSGIGRFISGTGAAANLKSNEWTGAGLIVIGEGAMEQMEKCVSSIAIGDRAQGFSKVSRDNIAIGADSLINVQAATEWYDQSRMEGTRNIGIGGNAGRGITSGYSNVSIGRNAGQGLGEGSSNIALGAGAMAGTAPVGFSGDIEVFWPSSTSRTIAIGEAVLQTYQGRAAQTAIGANAARNTKKAEKVTAIGSAAMENLERNRAPNGGDVVWTGTEAGTYAQSGKNITLTFPNIRGAQATYWVGIRLTSGTAQTLQNDVVPAQVVSVNGNTLIIQSSKELTATGAAELKYVYSVNSTATKNEELTIIGANAMNKALTAGYSTIIGVDAALLGDNYQKTTAIGASSLRTGSHISTTAIGYWVIPLASSEKCVAIGDSAGYRNVQGDFLTGKITNSIAIGYGARINGDNEIQIGTTGQTLYAPTAVNIRSDGRDKADVKPLTNGLDFVMKLKPMTGYYDRRDSYVDELFKDLPADERADKVREWWANPIKDGSHKEDRLRHWFIAQDIAALEDEYGRLPMVNKTNDTYTVEYETFIPVLTKAIQEMAARIETLETEMKESKK

SEQ ID NO: 376 - protein, 360 aa, Streptococcus pyogenes MGAS8232
MKNISRKCFMTSVVCIILGGILLGAGYATGGLQDIKHQTAPKKVIKTFDQITALDIDSSASTITVETGPVQRPTVTYYTHPKFIDPIVTTLTGKTLSLSQKPKDIVITGGIEILGFTLNNSRQEKNYRSITITVPEKTSLNEVKGSNVPHTTLSNLTVQDMQFDGNLTLLHTKVKKATITGMLEATKSQLTNLELKADYSFSNLTDSSVENGTISLGNGQLTTKDTTLKAINIQSLHPGGIEAERTTLENVTFTVSKSKEEEEENDYYDNDAIFTAHALTLKGTNTISGGDIDVDITLTKAKAIAYRARTENGKVSLGSQLTPAKIGKESTSDVISYVAENKAATGNLTVNLNKGDITIK

SEQ ID NO: 377 - protein, 204 aa, Streptococcus pyogenes MGAS8232
MFKKENLKQRYFNFGLVALALTILAIIFAFSSKNADTKSYAKKSESKMVTIDKAPKNNHAITKEESKEKAKSIASEPIPTVENSVAPTVTEEAPVVQQEVTQTVQQVSSVAYNPNNVVLSNGNTAGIVGSQAAAQMAAATGVPQSTWEHIIARESNGNPNAANASGASGLFQTMPGWGSTATVEDQVNAALKAYSAQGLSAWGY

SEQ ID NO: 378 - protein, 757 aa, Streptococcus pyogenes MGAS8232
MLEELKTLIKNPKLMITMIGVALVPALYNLSFLGSMWDPYGRVNDLPIAVVNHDKPAKRADKSLTIGNDMVDKMSKSKDLDYHFVSSKSAQKGLKKGDYYMVITLPEDLSQRATTLLNPEPQKLTIRYQTSKGHGMVAAKMGETAMAKLKESVSQNITKTYTSAVFSSMTDLQSGLKEASTGSQALDSGAKTAQMGSQMLSDNLAGLSSASWQFQQGTNRLTSGLTAYTAGVSQVKDGLGQLSTDMPVYLNGVSRLSQGASQLNQGLSQLTQSTTLSDDKAKRIQSLEVGLPVLNQGIQQLNENLSTMQVPKLNTDELGNNLAAIAQAAQQLLVKEAAAHKEQLAVLQATSAYQSLTAEQQGELTAALTQTDKGEAVAPAQTILRSVQTLSTSLQSLSQEDQSKQLEQLKEAVAQIANQSNQALPGASSALTELSTGLAKVNGSLNQQVLPGSNQLTTGLAQLNRYNTAIGSGVIKLSEGANALSSKSGELLDGSHQLSEGATKLADGSSQLSQGGHQLTSGLTELSTGLSILNGSLAKASQQLSLVSVTDKNAKAVAKPLVLNEKDKDGVKTNGIGMAPYMIAVSLMVVALSTNVIFANSLSGRPVKDKWDWAKQKFVINGFISTMGSIVLYLAIQLLGFEARYGMETLGFIMLSGWTFMALVTALVGWDDRYGSFASLVMLLLQVGSSGGSYPIELSGAFFQKLHPFLPMTYVVSGLRQTISLSGHIGVEVKVLTGFLLAFMVLSLLIYRPKKTV

SEQ ID NO: 379 - protein, 594 aa, Streptococcus pyogenes MGAS8232
MSRDPTYTINEHDLSFADGRFYVTFKADKSSETVRLNSSCLGNTIIKKLQVEDDNTMHDFVKPKVTTQQAFGLAQQVKELDLQLKDPKSDLWGKIKFNNKAMLVEYANKEMSSAIAQSAEQILLQVKSIDDERYSKFEQTLNGIKQTVKSESVESARTQLASMFDSRISGLDGKYSRLSQTIDSLSSRLDDGVGNYSTLSQKVSGIDLRVSNAANDVSRLSQTAQGLQSQITNANQNYSSLSQTVQGLQTTVRDNQSNATSRINQLSDLISTKVSKGDVETTIAQSYDKIAFAIRDKLPASKMSGSEIISAINLDRSGVKITGKNITLDGNSYISNAVIKDAHIANMDAGKINTGYLNANRIATEAITGEKIKMDYAFFNKLTANEGYFRTLFAKDIFATSVQSVTLSASKITGGVLAATNGASQWDLNNANMTFNRDATINFNSKNNALVRKDGTHTAFVHFSNATPKGYRGSALYASIGITSSGDGIDSASSGRFAGLRSFRYATGYNHTAAVDQTELYGDNVLIADDFSINRGFKFRPDKMEKVLDMNDLYAAVVALGRCWGHLANVGWNTAHSNFTSAVSRELNNYITKI

SEQ ID NO: 380 - protein, 1086 aa, Streptococcus pyogenes MGAS8232
MAADGKVTILVDVDGKQVKVLNSELDKVAKHGDKGSSSLKKFAVGAGVFKLASAAVDLVSQSLGKAITRFDTLEKYPRVMKAMGHSAEDVARSTDKLANGIDGLPTTLDEVVGTAQRLTSITKDINKSTNLTLALNNAFLASGASSEAASRGLEQYAQMLSAGKVDMQAWKTLQETMPYALQQTAEAFGFAGASAQKDFYEALKNGQITFDQFSNKLIELNDGVGGFAELAKENSKGIETSFNNIKNAIAKGVANSIKALDDLSKAATGKGIADHFDSLKVVINASFSAINASIKASTPLFKLLFSVIGAGISVVKALSPALVGVASGLAAMRAVNETITMIKALNRAWVMASASMSIGATTIKTVTAVQAVSTTMTKADMVARLSQLGVLKASTVIYGVMTGAISLSTAATIASTAAVTALKAALVALTGPVGWVVGAIGALVAVGVSLWSWLTKESDETKKLKKEQEGLVESNKQLRDSVREGVQERKKGLESVKESTAAHQKLADEIIKLAAKENKTAGEKQNLKNKIDQLNGSIDGLNLAYDKNSNSLSHNADQIKSRISAMEAESTWQTAQQNLLNIEQKRSEVSKKLAENADLRKKWNEEANVSDSVRKEKIAELTEEEAKLKNMQTQLQEEYNKTSATQQAAADAMAAAEESGSARQVIAYENMSEAQRTAIDNMRTKYSELLETTTSIFDAIEQKTALSVDQMNTNLEKNRAATEQWATNLEILAQRGVDQGILEQLRRMGPEGATQTQVFVDATDAELAPLQENFRAATETAKNAMGSVLDSAGVEMPEKVKGMVTNVSTGLQAELQAANFAQLGQEIPNGVSQGISQGAGKASDASVKMGQEVKRSFQGELGIHSPSRVFTEYGGHITDGLSNGVTNGTSKVMQTMQSLAQQMSQKGQQIVNDMRSKSNQITDAFSTMSGPMHSHGVNAMQGLANGIYAGSGAALAAAQSIAARITATIQSALDIHSPSRVMRDEVGRFIPQGIAVGIDADRKVIDSSMQKLKESMTINATPEIASGFGGGVAGIANQTTNNSNNSFTLNVKVDESDGNSHEKYQRLFREFSWYIQQQQGRLGDVK

SEQ ID NO: 381 - protein, 158 aa, Streptococcus pyogenes MGAS8232
MAKEPWEEKIVDDTIGTRTRKSRNAFISTPWLTALLSVFFVIIVAILFIFFYTSNSGSNRQAETNGFYGASTHKKTRKASNAKKTSSSSTTTDTTPSSEETLASSEGTGETLTVLAGEGAASIAARAGISVEQLQALNPEHMTQGYWYANPGDQVTIK

SEQ ID NO: 382 - protein, 423 aa, Streptococcus pyogenes MGAS8232
MSKRGKIKITTKTKLITASVITLVLIITGVVLWKQQQNTLTADIAKEPYSTVSVTEGSIASSTLLSGTVKALSEEYIYFDANKGNDATVTVKIGDQVTQGQQLVQYNTTTAQSAYDTAVRSLNKIGRQINHLKTYGVPAVSTETNKDEATGEETTTTVQPSAQQNANYKQQLQDLNDAYADAQAEVNKAQIALNDTVVISSVSGTVVEVNNDIDPSSKNSQTLVHVATEGQLQVKGTLTEYDLANVKVGQSVKIKSKVYSNQEWTGKISYVSNYPTESNAGSTTPAGSTGAGSSTGAAYDYKIDIISPLNQLKQGFTVSVEVVNEAKQALVPLTAVIKKDKKHYVWTYDDATGKAKKVEVTLGNADAQQQEIHKGVAVGDIVIANPDKNIKPDKKLEGVISIGTNTKPEKDSQSKNKKSGVDK

SEQ ID NO: 383 - protein, 408 aa, Treponema pallidum
MLRLPTARACITMGTMIRHTFTHRCGALLCALALGSSTMAATAAAKPKKGQMQKLRQRPVWAPTGGRYASLDGAFTALANDASFFEANPAGSANMTHGELAFFHTTGFGSFHAETLSYVGQSGNWGYGASMRMFFPESGFDFSTTTEPVCTPASNPIKQRGAIGIINFARRIGGLSLGANLKAGFRDAQGLQHTSVSSDIGLQWVGNVAKSFTSEEPNLYIGLAATNLGLTVKVSDKIENCTSTCEKCGCCKERCCCNGKKACCKDCDCNCPCQDCNDKGTVHATDTMLRAGFAYRPFSWFLFSLGATTSMNVQTLASSDAKSLYQNLAYSIGAMFDPFSFLSLSSSFRINHKANMRVGVGAEARIARIKLNAGYRCDVSDISSGSGCTGAKASHYLSLGGAILLGRN

SEQ ID NO: 384 - protein, 219 aa, Treponema pallidum
MSRTFRAWQCVGALCALSPLLPAYSSEGVREVPPSQSPQVVVAYEPIRPGDQLLKIGIVAGCQLYIAGGNGTNGSSSSGTNGNGNGKLLGGGGFHLGYEYFFTKNFSLGGQVSFECYRTTGSNYYFSVPITVNPTYTFAVGRWRIPLSLGVGLNIQSYLSKKAPGLIAEASAGLYYQYTPDWSIGGIVAYTQLGDIASSPDKCRAVGLATIDFGVRYHF

SEQ ID NO: 385 - DNA, 3807 bp, Escherichia coli 0157:H7
atgataaatttaagtaaggaagcaacggtggggaaagcattaacccctattgctatacttatgatgttgtcttttcctgtagcttctcaagcggcgggattagtcataaaaaatggaacggtatataacgccaatggtgtgccagtcgttgacatcaacaaacctaacggtagcggtttatctcataatatctgggataacctaaacgttgataaaaatggtgtcgttttcaataatagcgctaatgaatccagtacttcacttgccggaaatattcagggaaacagtaatctgacctccgggtcggcgaaggtgatcctgaatgaggttacttccaaaaatccttcaaccattaatgggatgatggaagttgcaggggataaagcggatctgattattgccaacccgaatggtattactgtaaacggtggcggttcaatcaatacaggtaaacttaccttaaccaccgggacgccggatatccaggatgacaagctggccggttactccgtgaacggcggtaccattacgctcggtaaactggataacgccagcccgacagaaattctgtcccgtaacgtggtagttaacggcaaagtgtctgccgatgagctgaacgttgttgctggcaataactatgttaatgccgcaggccaggtgaccggtagcgtatccgccacggggtcccgtaacggttacagcgtagatgttgccaaactgggcggaatgtatgcgaacaaaatcagtctggtcagcaccgagaaaggtgtgggggttcgcaacctcggcgttattgctgggggtgttaatggtgtcagcatcgattccaaaggtaacctgttaaacagtaacgcccagattcagtctgcaagcacgatcaacctgacaacaaatggtactctggataacaccaccggtacggtgacatctgtaggcactatctcgcttaataccaacaagaatactatcgtgaatacccgtgcgggtaacatctctacgatgggcgatatctacgttaacagcggtacgattgacaatactaacggcaagcttgcggctgcaggaatgctggcggttgataccaataacgccacgctgattaactctggtaaagggagttctgtcgggattgaagcggggctcgtggcgctgaaaaccggaacgctcaacaacagcaatggtcagattcgcggtggctatgtgggtcttgaatccgctgcgctgaataacaacaacggtgatatccagaccaccggcgatatcgccattatcagtaacggtaatgtggataacaacaaaggtctgatccgttcgtccaccgggcatatcgttattggcgcggcaggtagcgtaaataatggttcaaccaaaaccgccgataccggcagttctgactctctgggcattattgcagataccggcgtagaaattggtgcgaacaacatcaataacaacggcggacagattgcgtctaatggcaacgtctccctgtcaagttacagcacgatcgacgactatgcgggcaaaattctgtccaacagcaaagtgattatcaagggaagctctctgcgtaacgataccggggggatcagcggtaagcagggtattgaagtcgccgttggcggcagcctgaccaataatattggcgtgatcagctctgaagagggtgatatctccctgttagccaactccgtggataaccacggcggcttcatgatggggcagaacatcacgatggagtcgatgtctggcgtcaataacaacacagcgctgatcgtggccagcaaaaaactgaagataaatgcgcgcggcagtatcgaaaaccgcgatggcaataacttcggtaatgcttatggtctgtacttcggcatgcctcagcaaacgggtggaatggtcggcaaggaaggcatcgagctttccgggcagaacatctataacaacaacagccgtcttatcgctgaggatggtcctctgactctgcaggcgcagaacacgttcgacaacacgcgtgctctggtcaccagcggggcggatgcatctattcaggttggcggaacgtattacaacaactacgctaccacctggagtgcgggcaacctggatatcgacgcgaccacgctgcaaaacagcagcagcggtacgatgatcgataacaatgcgaccgggttcatagcatctgataaaaacctgtcactggaagtggtgaatagccttaccaactacggctggatcagcggtaaaggcgatgttgatgtcacggtgaataacggcaacctgtataaccgcaataccattgcggctgaaaaggggctggatattgccgcgttgaacggtattgaaaactggaaggatatttctgctggcggcgacctgacgatgaacaccaatcgccatgtgaccaacaactccaacagcaatatggtggggcagaatattgttattaacgcggttaacgatatcaacaaccgtggcaacattgtcagtgacgctgacctgaacgtgacgaccaaaggcaacctgtataactatctctatatggtagggtatggggatatcgcattgtcggcaaatagcgtggcgaacaataacgcgaccatcgaagcgacaggcgatctgattatcgattcgaagggtaacgtgggtaacaaccgcggtaatctgcatgcgttgaacggcgtgttgtctgttaaaggcaacaatctgaacaacgataacggtgaaattcgtggttatggcgatgtcacgctggcactgacgggcaactacgacagctataagggttcgctgacctctgaaacgggcgacgtgactctgacggcgaacattgtagacaacgcctatggtttgattgccggtgagaatgtttctgtcgatgctaaatcgacgatttacaacaacactgcgctgatcgcggcgaataaaaagctggttattaacgctggcggcaacctcgaaaaccgcgacgggaataacttcctgcgtaataacggcgcgctgtttggaattaccgacaacgttggcggcatcgtaggtaaagaaggtgtcacgctttctgctcagaacgtctacaacaataacagcagcatcatcgctgaaaatggtccgcttaatctgctgtccaggggaacgctggataatacccgcgcgcttcttagcagtggggctgatgccatcatccgtgcggcagggacgttctacaacaactatgccaccacgtacagcgccggtaatctcgacgtttatgcggcgtcgttgaacaacgccagcgatggtcgcctggaagacaataccgccacgggcgtgattgcgtctgacaaaaacctggatctgagcgttgataacagtgtcactaactatggttggatcagcggtaaaggagatgtgcatttcaatgttctgaaaggcacgctgtataaccgtaatgccatcgcggcggacaacgcgctgaccattaatgccctgaacggtgttgagaactttaaagacattgtggcgggtactgcgctgactattgatacgcagaagtatgttaccaacaacagcaacagtaatatgttgggacaaaccatcgcgatcaatgccgtgaatgacattaataaccgtggaaatattgtgggtgattattctctgggtgttaaaaccaccggtaatatttataactacctcaatatgctgagttatggtgtcgctggcgtatcggcaaataaggttacgaatagcggtaaagacgctgttctcggtggcttctacggtttagcgttagaagcaaacgaaactgataacaccggtactattgtcggcatgtaa

SEQ ID NO: 386 - DNA, 4716 bp, Escherichia coli 0157:H7
gtgaacacaatacacttgcgctgtctcttcaggatgaatcccctggtctggtgcctgtgggctgatgttgcagcaaagctaaggtcgcttaaacgctactcagtattcacttttcagaggatgaaatttatgaacaggaccagtccctattattgtcgtcgctcagtactttccttattgatatctgccttgatatatgccccgcccgggatggctgccttcactcctgatgttattggtgtggtaaacgatgagactgtagatggcagccaacgagtagatgaacgaggtacaacaaataacactcatattatcaaccatggccagcagaatgtttatggcggggtatctaatggaagtcttattgaatctggtggatatcaagatgtaggaaggcataacaattatgtggggcagtctaataataccaccattaacgggggcagacagtcaattcatgacgggggtatttccacaggtacgataatcgagagtggcaatcaggacgtttataaagggggtatcagcaatggaacgacaattaagggcggtgcttcacgcgtagagggagggagtgcgaatggaacactcattgatggtggtagccagatagtaaaagttcaagggcatgctgatggtacaacgataaataagtctggctctcaggacgtagtacaaggaagtctggcaacgaacacaaccataaatggtggtcgacagtatgttgaacagagcacagtagaaacaaccaccatcaaaaatggcggtgagcaaagagtatatgagagccgtgcgctggacacgacgattgaaggcggaactcagtctctgaatagtaagtcaacggcaaaaaatactcagatctattctggtggtacgcaaattattgataacaccagctcctcggatgttattgaagtttattccggtggcgtgcttgatgttagtggtggtacggcaacaaatgttacccagcacgatggtgcaattttaaaaactaacactaacggtacgacggtgagcggtacgaatagtgaaggtgcattctccatccacaatcacgtggcagacaatgtgttgctggaaaacggtggtcatttagacataaacgcatatggttcggcaaacaagacgattattaaagataaaggaacaatgtcagttttaaccaatgctaaagctgatgcgacccgaatagataatggcggggttatggatgttgcaggaaacgcgacaaataccataattaatggtggcacacagaatattaataattatggcatagccacaggcaccaatatcaacagcggaacgcaaaatatcaaaagcggcgggaaagctgacacaacaattatatcctccgggagccggcaggttgttgagaaagatggtacggcaattggcagcaatattagcgccggaggctcgctgattgtctataccggcggtattgcacatggggttaaccaggagacgggcagtgctttagttgccaacacgggtgcagggactgatatcgaaggatacaacaagctctctcacttcactattaccggaggggaggctaattatgttgtgctggaaaataccggcgaactgacggtagtggctaaaacctcggcgaaaaatactaccattgatgctggcggtaagctgattgtccagaaggaggctaaaacagatagcaccagacttaataatggcggcgttctggaggttcaggacggtggtgaggctaagcatgttgagcaacaatccggcggcgcattaattgcttccacgacctccggaacacttatcgaaggaaccaacagttatggtgatgctttctacatcaggaattcagaagctaaaaatgtagtgctggaaaacgctggctcattaacagtcgtcactggttcccgggcagttgacacgattattaatgccaacggcaaaatggatgtttatggaaaagatgttggcactgtactcaatagtgctggcacccaaacaatatatgccagtgccacttctgataaagcaaatatcaaaggtggcaagcaaacggtatatggtttagccactgaagcaaatatcgaaagtggtgaacaaattgttgatggtgggtcaacagagaaaacacacatcaatggtggcacgcaaaccgttcagaattatggtaaggcgatcaataccgatatcgtctctggcctacaacaaattatggcaaacgggacagcggaaggttccattattaatggcggttcacagatagttaatgagggcggtctggctgaaaactcggtgcttaatgatggcggcacactcgatgtgcgggagaaaggcagcgcaacggggatacagcagagtagccagggcgcgttggttgcaaccaccagggcgacgcgggtcacaggaacacgcgcggatggcgtcgcgttcagcatcgagcagggtgcggcgaacaatatcctgctggcaaatggcggagtgttaaccgtggagtcagacacctcttctgacaaaacacaggtcaatacgggcggacgggagatcgtcaaaacaaaagccactgcgacaggcacgacgctcaccggcggtgaacaaattgtcgagggtgtggcgaatgagacaacaattaacgacggcggaatacaaacagtttcagctaacggagaggcaataaaaacaacgatcaatgaaggcggtacgctgacagtcaacgataatggcaaagcgacagatatcgtccagaacagcggtgccgctctccagacgagcacggctaacggtattgaaatcagcggtactcaccagtacggcactttttccatttccggcaatttagcgaccaatatgttgctggaaaatggcggtaatttattggtattagcaggtaccgaagctcgcgactccacggttggcaaggggggggcaatgcaaaaccagggtcaggactccgccacaaaggttaactctggtgggcaatatacccttgggcggtcaaaagatgagtttcaggctctggcccgggcagaagatctccaggttgctggcgggacagcaatcgtctacgcaggtacgctggcggatgcatcggtcagtggcgcgacaggaagcctgtcgttaatgacgccacgggataatgttacgccagttaaactcgaaggggcgatccggattaccgatagcgcgacattaactatcggcaatggcgttgatacgacgcttgccgacctgacggctgccagccggggcagtgtctggcttaacagcaataattcctgtgcaggcaccagcaactgcgagtatagagtaaacagtttgctacttaacgacggtaatgtttatttatcagcacaaacagcagcgcctgccacaactaacggtatatacaatacgctgacaaccaatgaactttccggtagcggtaatttctacctgcataccaacgttgcaggctctcggggcgatcaactggtcgtcaacaacaacgccactggtaattttaaaatctttgttcaggataccggcgtcagtcctcagtctgacgacgcgatgacgctggtgaaaacagggggaggggatgcttcgttttcgctgggcaatactggcggtttcgttgatcttgggacctatgagtatgtcctgaaaagcgatggcaacagcaactggaacctgaccaatgatgtcaaacccaacccggatcccaacccaaatcccaacccaaatccgaagccggatccaaaaccagacccaaaaccggatccgaaaccagacccgactcccgagccaacgccgacacccgttccggagaaacgcatcacgccttctaccgcagccgtactcaatatggcagcaacattaccgttggtatttgatgctgagctaaacagtattcgcgagcggttgaacataatgaaagcgagtccacacaacaataatgtctggggggcgacgtataacacccgtaataatgtcaccaccgatgcgggggccgggtttgagcagacgctgaccggaatgacagtggggatcgacagccctaatgatattcctgaggggattgcgacgctgggcgcttttatgggttattcccattcacatatcggttttgatcgcggaggacatggcagtgtgggcagttattctctgggcggctatgccagttgggaacatgaaagtggtttctatctggacggtgtcgtgaagctgaaccgttttgaaagtaacgtagccggtaaaatgagcagcggtggagccgccaatggcagttaccacagcaacgggctgggcggtcacattgaaaccgggatgcgatttaccgatggtaactggaacctgacgccgtatgcatcgttaacggggttcaccgctgataaccccgaatatcatttatccaatggcatggaatcgaaatcagtcgatacccgcagtatatatcgtgaactgggcgcaacgctgagttacaacatgcgtctggggaacggtatggaaattgagccgtggctgaaggcggctgtgcgcaaagaatttgtcgatgataaccgggtgaaggtgaataatgacggtaatttcgtcaatgatttgtcgggcagacgtggaatataccaggcaggtattaaagcctcattcagcagtacgttaagcgggcatcttggggtggggtatagccatggtgccggtgtggaatccccgtggaacgcggtagctggtgtgaactggtcgttctga

SEQ ID NO: 387 - DNA, 2916 bp, Escherichia coli 0157:H7
atggcagtaaagatttcaggtgtactgaaagacggcacaggaaaaccggtagagaactgcaccattcaactgaaagccagacgtaacagcgccacggtggtggtgaacacggtggcctctgaaaatccggatgaagccggtcgttacagcatggacgttgagtacggtcagtacagcgttattctgttggtggaagggttcccgccgtcacatgccgggaccatcaccgtgtatgaagattctcaacccggtacgctgaatgattttcttggtgccatgactgaggatgatgtccgtccggaggcactgcgccgttttgagctgatggtggaagaggtggcgcgtaacgcgtccgcggtggcacagaacacggcagccgcgaagaagtcagccagcgatgccagcacatcagcccgtgaggcggcaacccatgcgactgatgctgcggactcagcacgcgcagccagcacgtcagccggacaggccgcgtcgtcggctcagtcagcgtcttccagcgcaggaacggcatcaacaaaggctactgaagcatcaaaaagtgctgccgctgcagagtcctcaaaaagcgcggcggctaccagtgccggtgcggcgaaaacgtcagaaacgaatgcggcagtgtcacaacaatcagccgccacttctgcatccaccgcgaccacgaaagcgtcagaagctgcctcctcagccagggatgcgtcggcttcaaaagaggcggcaaaatcatcagaaacgagcgcagcctcgagcgccagtagtgcagcctcctcggcaacggcggcaggcaattccgcgaaggcggccaaaacgtctgagacaaacgctaagtcctctgaaacggcagcagaacagagtgcctccgcagcagcaggctcaaaaacagcggctgcattatctgccagtgccgcgtcaacaagtgccgggcaggcctcagccagtgccaccgccgccggaaaatcggcagaaagtgccgcatcgtctgcttcaacagccacaacgaaggctggcgaagccactgaacaggccagcgcagcagcgagttctgcttccgcagcgaagacatccgaaacgaacgcgaaagcgtcggaaaccagcgcagaatcctcaaaaacggctgccgcatcgtcagccagttcggcggcgtcatcggcatcatctgcgtctgcttcaaaagatgaggcgaccagacaagcgtcagcagcgaagagcagcgccacgacggcatccacgaaggcgacagaggcagctggtagtgcgacggcagcagctcagagcaaaagtacggcggaatctgcagcaacgcgcgctgagacagcggcaaaacgggcagaggatattgcatccgccgtggcgcttgaggatgcgagcacgacgaaaaaggggatagtacagctcagcagtgcgactaacagcacttccgagtcactggcggcaacgccaaaagccgttaaggccgcgtatgagctggctaacgggaaatacaccgcacaggatgcaacgacagcacagaaagggatagttcagcttagcaacgcgaccaacagcacatctgaaatgctggcggcaacgccaaagtcggtaaaggcagcctatgaccttgctaacgggaaatatactgctcaggacgctacgacagcacaaaaaggaattgtccagctcagtagtgcaaccaacagcgcatctgaaacgcttgccgcgacaccgaaagcagtgaaagcagctaatgataatgcgaatggtcgggtaccttctgcccgtaaggtgaatggtaaggcgctttcatcggatataacactgacgccgaaagatattggtacgcttaactcaacaacaatgtcattcagcggtggtgctggttggttcaaattagcaacggtaaccatgccacaggcgagttctgttgtttcaattacgttgattggtggcgcgggatttaacgtggggtcacctcaacaggcaggtatatctgaacttgttttgcgtgcaggtaatggtaatccgaaggggattactggtgctttatggcagcgcacatcgacagggtttacaaattttgcctgggtcaatacatctggtgatacttacgatatttacgttgcaatcggaaattatgcgactggtgtaaatattcaatgggattataccagtaatgccagcgtgacgattcatacgtcaccagcatattctgctaataagccggaagggttaacggacggtacagtttattcactctatacgccatcagagcagttttatccgcctggcgcaccaatcccgtggccatcagataccgttccgtctggctatgccctgatgcaggggcagacttttgacaaatctgcatacccgaaacttgcagccgcttatccgtcaggcgtgatccctgatatgcgtggctggacgattaagggcaaacctgccagtggtcgggccgtattgtctcaggaacaggacggcattaaatcgcacacccacagcgccagcgcatccagtacggatttggggacgaaaaccacatcgtcgtttgattacggcactaaatccacgaataacaccggggcgcacacgcacagtgtgagcggtacagccgcaagtgccggaaaccatactcatagtgtcacaggcgcatcagcagtcagccagtggtcacaaaatgggtcagtacataaggtagtgtctgcggccagtgtgaatacaagtgctgcaggagcgcacactcatagtgtcagcggcacagctgcatctgcaggtgctcacgcacatactgtcggtattggtgctcatacgcactctgttgcgattggctcacatggacacaccatcaccgttaacgctgcgggtaacgcggaaaacactgtcaaaaacatcgcatttaactacattgtgaggcttgcataa

SEQ ID NO: 388 - DNA, 903 bp, Escherichia coli 0157:H7
atgaaacgagttattaccctgtttgctgtactgctgatgggctggtcggtaaatgcctggtcattcgcctgtaaaaccgccaatggtaccgctatccctattggcggtggcagcgctaatgtttatgtaaaccttgcgcctgccgtgaatgtggggcaaaacctggtcgtagatctttcgacgcaaatcttttgccataacgattatccggaaaccattacagactatgtcacactgcaacgaggctcggcttatggcggcgtgttatctaatttttccgggaccgtaaaatatagtggcagtagctatccatttccgaccaccagcgaaacgccgcgggttgtttataattcgagaacggataagccgtggccggtggcgctttatttgacgcctgtgagcagtgcgggcggggtggcgattaaagctggctcattaattgccgtgcttattttgcgacagaccaaaaactataacagcgatgatttccagtttgtgtggaatatttacgccaataatgatgtggtagtgcctactggcggctgcgatgtttctgctcgtgatgtcaccgttactctgccggactaccctggttcagtgccaattcctcttaccgtttattgtgcgaaaagccaaaacctggggtattacctctccggcacaaccgcagatgcgggcaactcgattttcaccaataccgcgtcgttttcaccagcgcagggcgtcggcgtacagttgacgcgcaacggtacgattattccagcgaataacacggtatcgttaggagcagtaggaacttcggcggtaagtctgggattaacggcaaattacgcacgtaccggcgggcaggtgactgcagggaatgtgcaatcgattattggcgtgacttttgtttatcaataa

SEQ ID NO: 389 - DNA, 549 bp, Escherichia coli 0157:H7
atgggctacgttacaggtggattaccaatgaagaataaccgtgcgtgggcgcttatcagtggtctgatattgttcagcggaacggccccagctgccgataacctgcattttaccggtaatttgcttggtaaatcctgtactcctgtaatcaatggcaacttacttgcagaaattcatttccccacaattgctgccagcgatttaatgcaacgtggtcagtcagatcgcgtaccgttagtttttcagttgaaagattgcaaaagcaccacggcgtttaatgtcaaggtgaccttgatgggaacagaagataccgacttaccaggatttctgtcgattgattcgtcatcttctgcaacgggtgttgggattggcattgaaactgccggaggggcggctgtacctattaacagtaccacaggtgcctcatttccattaaatcagggaaataacagtgtcaattttaatgcctggttacagaccgtaaatggacgaaatgttacatcgggtgatttcaccgccacaatgacggtaacttttgagtatttttaa

SEQ ID NO: 390 - DNA, 2850 bp, Escherichia coli 0157:H7
atgaaacgacatctgaacaccagctacaggctggtatggaatcacattacgggcaccctggtggtggcctccgaactggcccgctcacggggaaaacgcgccggtgtggcggttgcgctgtctcttgctgctgtcacatcagtcccggcactggctgctgacaaggttgtacaggcgggagaaaccgtgaacgatggaacactgacaaatcatgacaaccagattgtcttcggtacggccaacggaatgaccatcagtaccgggctggaactggggccggacagtgaagaaaacaccggtgggcaatggatacagaatggcgggatagccggaaacaccactgtcaccacaaatggtcgtcaggtcgtgctggaggggggaacagccagtgatacggttattcgtgacggcgggggacagagcctgaacggactggcggtgaacaccacactgaataacagaggcgagcagtgggtgcatgagggcggggttgccaccggtacaattatcaaccgcgacggttaccagagcgttaaaagtggcgggctggcaacaggaaccatcatcaacaccggcgcagaaggcggccctgattctgacaactcgtatacgggtcagaaggtccagggaacagcagaatccaccaccatcaacaaaaatggacggcagattatcttattttccgggctagcccgtgacactctcatttacgcaggtggtgaccagtcggtacacggaagggccctgaataccacactgaatggcggttaccaatatgtgcacagggacggacttgcgctgaacacggtaattaacgaggggggctggcaggttgttaaggcaggtggcgctgccggtaacaccaccataaatcagaacggtgaactgagggtacatgccggcggggaagccactgcagtcacccagaacacgggcggtgcactggttaccagtactgctgcaactgtcatcggcacaaaccgtctggggaatttcacggtggaaaacggtaaggctgacggtgttgttctggaatccggcggtcgtctggatgtactggagagccattcagcacagaataccctagtggatgacggcggtaccctggcagtgtctgccggcggtaaggcgacaagtgtcaccataacatccggtggtgccctgattgcagacagtggtgccactgttgaggggaccaatgccagcggtaagttcagtattgatggcacatccggtcaggccagcggcctgctgctggaaaatggcggcagctttacggttaatgccgggggacaggctggcaacaccactgtcggacatcgtggaacactgacgctggctgccgggggaagtctgagtggcagaacacagctcagtaaaggcgccagtatggtactgaatggtgatgtggtcagtaccggcgatattgttaacgcaggggagattcgctttgataatcagacgacaccgaatgccgcgctgagccgtgctgttgcaaaaagtaactccccggtaacgttccataaactgaccaccacgaacctcaccggccagggcggcaccatcaatatgcgtgttcgccttgatggcagcaatgcctctgaccagctggtgattaatggtggtcaggcaaccggcaaaacctggcttgcgtttacaaatgtcggaaacagcaacctcggggtggcaaccaccggacagggtatccgggttgtggatgcacagaatggcgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatacatccatgttgacacaggcaatggactatgaccggattctggcaggctcccgcagccatcagaccggtgtaaacggtgaaaataacagcgtccgtctcagcattcagggcggtcatctcggtcacgataacaacggcggtattgcccgtggagccacgccggaaagcagcggcagctatggcttcgtccgtctggagggtgacctgctcagaacagaggttgccggtatgtctctgacgacaggggtgtatggtgctgcaggccattcttccgttgatgttaaggatgatgacggttcccgcgccggcacggtccgggatgatgccggcagtctgggcggatacctgaatctggtacacacatcctccggcctgtgggctgacattgtggcccagggaacccgtcacagcatgaaagcgtcatcggacaataacgacttccgcgcccggggctggggctggctgggctcactggaaaccggtctgcccttcagtatcactgacaatctgatgctggagccacaactgcagtacacctggcagggactctccctggatgacggccaggataacgccggttatgtgaagttcgggcatggcagtgcacaacatgtgcgtgccggtttccgtctgggcagccacaacgatatgacctttggtgaaggcacctcatcccgtgacaccctgcgcgacagtgcaaaacacagtgtgagtgaactgccggtgaactggtgggtacagccttctgttatccgcaccttcagctcccggggtgacatgagcatggggacagccgcagccggcagtaacatgacgttctcaccgtcccggaatggcacgtcactggacctgcaggccggactggaagcccgtatccgggaaaatatcaccctgggcgttcaggccggttatgcccacagcgtcagcggcagcagcgctgaaggctataacggtcaggctacgctgaatatgactttctga

SEQ ID NO: 391 - DNA, 1083 bp, Escherichia coli 0157:H7
atgaaaaaatggcattatatattttgcataattctctttcatttagggttaccgtgcgggtatgcggcaaatgatggcacgtgtgcaacaagaggcggcacacatacattaagccttaattttcctctgacaacggtcagtgcagcaaacaatgtgcctggaaatacattaatagatattgctaatgcaacatcttctgaaaattatagcgttctgtgtaactgtgattcaaaacatagcaatggcgcttatcacgaaatatattataccgcagaccctgctcccggtatggtttatagcaccaccgcaagtggtcttgctttttactatcttaacgaatatgtcgatgtgggaacaaaaatatctgtgctaaatgcggggtatacggcagttccttttgaacatgtttccaaccaggcaactacaacagatcacacttgtcagggaaacaaaactacagcggttggcgtgagcctgaaaactggagcagatgcgaagatttcatttcgtattaaacgttcaataaatggaacggtagtaatacctatcaccgatattgcattgctgtatgccaacatatccagcaccacgacccgtggtgaggcgattgcaaaagttcgaatttcaggcagtttgaccgcaccacagtcttgtcagataaatgcaggacaggtgatttattttgattttgatactattcctgcgtccgaattttcatctaccgccgggcaagccattacttcacgaaaaatcactaaaacagtgagtattgagtgtacggggatggggtatgagcgtacgcagaaagtcgatgcttcttttacggggacgaaccgaagcagtgacgatacgatggtggcgacagacaatgctgatgtcgggatcaaaatttacaataaatcgaatgctgaagttagcgtcaacaacggcaagttacccgcagacatgggcaacacgaccatttttggtcgtaaaaatggttcggtaactttttcggcagcacctgccagctttaccggtgcccggcctcagcccggcgtttttaacgctaccgcgaccttaaccattgaatttgtaaactaa

SEQ ID NO: 392 - DNA, 4254 bp, Escherichia coli 0157:H7
atgtcacgttataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaattttattaccggaatggccaccgctaaagctaaccaggaaatacaggagtggctcgggaaatatggtacagcgcgcgtcaaactgaatgtcgataaagatttctcgctgaaggattcttcgctggaaatgctttatccgatttatgatacgccgacaaatatgttgttcactcagggggcaatacatcgtacagacgatcgtactcagtcaaatattggttttggctggcgtcatttttcaggaaatgactggatggcgggggtgaacacctttatcgaccatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggttgggatatccgcgcagagggctatttacctgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagcggtgagaatgacactcgctttggcctggaagttaactaccgaattggcgaacctttggcgaaacaactcgatacggatagcattcgcgagcgtcgggtactggcaggcagccgctatgacctggttgagcgtaataacaacatcgttcttgagtaccgcaaatctgaagtgatccgtattgctctgcctgagcgtattgaaggtaagggcggtcagacactttccctggggcttgtggtcagcaaagcaactcacggactgaaaaatgtgcagtgggaagcgccgtcattactggctgaaggtggcaaaattaccggtcagggtagtcagtggcaagtaacgctcccggcttatcgtccaggcaaagacaattattatgcgatttcagcagttgcctacgataacaaaggcaatacctcaaaacgcgtgcagacagaggtggtcattaccggagctggtatgagcgccgatcgcacggcgttaacgcttgacggtcagagccgtattcaaatgcttgctaacggtaatgagcaaaaaccgctggtgctgtctctgcgcgacgccgagggccagccagtcacgggcatgaaagatcagatcaagactgaactaactttcaaaccggctggaaatattgtgactcgttccctgaaggccactaaatcacaggcaaagccaacactgggtgagttcaccgaaactgaagcaggggtgtatcagtctgtctttactaccggaacgcagtcaggtgaggcaacgattactgttagcgttgatggcatgagcaaaaccgtcactgcagaactgcgggccacgatgatggatgtggcaaactccaccctgagcgctaacgagccgtcaggtgacgtggttgctgatggtcagcaagcctatacgttgacgttgactgcggtggactccgagggtaatccggtgacgggagaagccagccgcttgcgatttgttccgcaagacactaatggtgtaaccgttggtgccatttcggaaataaaaccaggcgtttacagcgccgcggtttcttcgacccgtgccggaaacgttgttgtgcgtgctttcagcgagcagtatcagctgggcacattacaacaaacgctgaagtttgttgccgggccgcttgatgcagcacattcgtccatcaccctgaatcctgataaaccggtggttggggggacagttacggcaatctggacggtaaaagatgcctatgacaaccctgtgaccagcctcacgccggaagcgccgtcattagcgggtgccgctgctgaaggttctacggcatcgggctggacaaataatggtgatgggacgtggactgcgcagattactctcggctctacggcgggtgaattagaagttatgccgaagctaaatggacagaatgcggcagcaaatgcggcaaaagtaaccgtggtggctgatgcgttatcttcaaaccagtcgaaagtctctgtcgcagaagatcacgtaaaagccggcgaaagcacaaccgtgacgctggtggcgaaagatgcgcatggcaacgctatcagtggtcttgcgttgtcggcaagtttgacggggaccgcctctgaaggggcgaccgtttccagttggaccgaaaaaggtaacggttcctatgttgctacgttgactacaggtggaaagacgggcgagcttcgcgtcatgcctctcttcaacggccagccagcagccaccgaagccgcgcagttgacggtcatcgccggagagatgtcatcagcgaactctacgcttgttgcggacaataaggctccgaccgtcaaaacgacgacggaactcaccttcaccgtgaaggatgcgtacgggaacccggtcaccgggctgaagccagatgcaccagtgtttagcggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaacgttgcaggtgacgcatctaaggctgagattcgtgatatgacagtgaaggttaataaccaactggctaatggacagtctgctaaccagataaccctgaccgttgtggacacctatggtaacccgttgcaggggcaggaagttacgctgactttaccgcagggtgtgaccagcaagacggggaatacagtaacaactaatgcggcaggtaaagcggacattgagcttatgtcaacggttgcgggagaacacaatatttccgcttcggtgaatggtgctcagaagacggtcacggtgaaattcaacgcggatgccagcaccggtcaggcaaacctgcaggtagacgccgctgctcaaaaagtggcaaacggcaaagatgcctttacgctgacggcgaacgttgaggataaaaatggtaaccctgttccagggagcctggtgacctttaatctgccccggggtgtcaagccgcttacaggcgataatgtctgggtgaaagccaacgatgaggggaaagcagagttgcaggtggtttcagtgactgccggaacgtatgagatcacggcatcggcagggaatagccagccttcgaatacgcagactataacgtttgtagccgataaggctaccgcaaccgtctccggtattgaggtgattggcaactatgcactggcggacggcaatgccaaacagacgtataaagttacggtgactgatgccaataacaacctgttgaaagatagcgaagtgacgctgactgccagcccggcaaatttagttctgactcccaatgggacggcgaaaactaatgagcaaggacaggctattttcaccgccacgaccactgtcgcagcgaaatatacactcacggcgaaagtgagtcaggccgacggtcaggaatcgacgaaaactgccgaatctaaattcgtcgcggatgatacaaatgcagtactcaccgcatcatctgatgtgacttctctggtggcggatgggatatcgactgcgaagctggaggtgacactgatgtcggcaaataaccccgttggggggaatatgtgggtcgacattaagacgccagaaggggtgacggagaaggattatcagttcctgccgtcgaaaaatgaccatttcgtgagcggaaaaatcacgcgtacatttagtaccagcaagcctggtgtctatacgttcacatttaacgccctgacgtatggcgggtacgaaatgaagccagtgacggtgaccattaccgcggtggatgccgatacggcaaagggcgaggaggcgatgaactaa

SEQ ID NO: 393 - DNA, 4740 bp, Escherichia coli 0157:H7
atggcgcgtggttgggcgtcttcagaagcctcaggcgcgatgactgattggttaaataactttggtactgcgagaatctctctgggtgtggatgaagattttagcctgaaaaattcgcaattcgacttcctgcatccgtggtatgacacacctgattatctgctcttcagccagcatacccttcaccgaacagacgatcgtacccagatcaacaccggtttgggctggcgtcatttcacctccagctggatgtcaggcatcaaccttttttttgaccacgacctgagccgctatcactcccgcgcagggcttggcgcagaatactggcgtgattatctgaagttgagcagcaacgcttatatcggcctgaccggctggcgtagcgcaccagaattggataacgacttcgaagcccgcccggccaacggctgggatttacgcgcggaaggctggttacctgcctggccacaactggggggaaaactggtctatgaacaatactatggcgatgaagtggcgctgtttgacaagaatgatcgtcaaagtaacccccatgctattaccgcaggcctcaactatacccccttcccgcttctgactctcagtgcggaacagcgtcaggggaagcaaggtgaaaatgacacacgttttgccgttgatctgacctggcaacccagcagttcaatgcagaaacagcttaatccggacgaagtggccggacggcgcagtctggccggtagtcgttatgacctgattgatcgcaacaacaacatcgttctggaataccgcaagaaagagctgattcgcctgagtctgctggatccggtgaaagggaagtctggagaaataaaaccgctggtttcctcgctacagaccaaatatgcccttaaaggctataacatcgaagccgctgcgctggaagctgccggaggtaaagtcagcacgtctggaaaagatatcacggtcacgctgccaggttaccgcttcactaacaccccagaaaccgataatacatggtcgatagacgttaccgccgaggatgtaaaaggtaacctgtcacggcatgaacaaagcatggtagttattcaggctccgacattaagccagaaagattctctgttatccgtcaatccgctaaccgtggctgcagataaaaaatcgacgaccacattgaccgttactgcgcacgattccgacggaactccggtgccggggctggcgctgcaaacccgcagtgaaggcgttcaggatatcaccctgtctgactggacagataacggtgatggtagttacacacagatactgaccgccggaacgacatcaggttcagtaacactgacgccgcaaattaacggtgagagtgcggtaaaagaatccatcgtcgttaatatcgtccctgttgtctcatcccgcgaccattcatcaataacaattgataacgtatcgtattatgccggagacgacatcaaggttagggtggaactgaaagacgatagcaatcaaccggttgcatatcaaaaagaggaattggtaaaagccgttactgtcgaaaacagcaaacctggcgccacgattgtctggcacgaagagcagccgggggtttatgccgcgaattatccggcctataagcaagggactgcactaagggcacaacttagccttcacaactggaatgctccactgcaatcgcatatttataacattgaggcaaaccagaataaggctcgcgttgccacattatcagcgacaaataatgacgtttacgccgataaaaagacatttaataccctcacgatcaacgtcactgatgagagtgataatcccctgacaaatcatcaggtcacctttaagaatgaaaaaggaagcgcggagtttgtcgaaccgccgcagcaaaatacggatgcatatggtgttgccacaataaacatggtaagtcaggttgcggaagaaaatacgattagcgccacgctgccaaatggtttttcacaacggataattgcgaaattcgttagcgattcgagtacgccaaaattcaaacaactggttgccgatccagataccattattgctggcaacagccagggcagtactctgaccgccatcatcacagactttcataacaacccgttaaaagatatgaaagtgaattttgtggcacctggtggctcgcaactggacaacacgaccgccacaacagaccagtccggtattgtgcgggtgcacctgaccagttcaaaagctggtagctattccgtcgatgcctcgcttgaggtggataaaaatattcaccagtcggtcacgatcaccgtggtcccaaacagggaacaatcggtaatgaccttgaatgccgggtcgggcagtgcgatcgctaacaatacaaatatcgttaccctgactgccagtgtgaaagatgtttatggacacccgttgccggatgaggatgtgaaatttaccttgccagcctccatgaccgggaacttcacgctaagtagtgaaaccgcccgcaccgatgcaaacggtgatgccgtggtcacattgcgaggcacaaaagcgggtgagtttacagttacggcgacgctgaccagaaataataccgttgcttatcagcaagtcacttttattggggatacaaacagtgcgcagctccagccgctgactgcctcattaaattccattgttgcgggtaacagtacggggagtaccctgacggcaacgatcctggacgcttaccaaaatccgcttaaagaccagttggtcactttccagagtaacgatgtcactctaagcgaaacagaagtcaccaccaatacgctgggtcaggcgacggtaacaatgaccagcaatattgccggacaacataacgtcgtggtgagccggaaagcgcaagcttccgataataaaacgtttagtttatcagtgctaccggatgaaagttcggcgaaggtaataagtataaccggagccgaaaaaacgataacggtgggcgaaaacatcacgctacggatactcgtccaggacgcgtttaacaatgtaatcgcgggtcaacgcgtcagattaagtgcgcagccaacaactaacattacgataggcgatacggcttacaccgataataacggttatgcgtacgttaaccttctcagcacccaacctggggtttatcaggtgacggcaacgctggacaataacagtagtagtaaggttgacgtgaatgtggcaaatggcaaactcgagttaacatcatcgaaaccagaaactacggtccataatagtgagggtattacgctgaccgcaacggcgagaaatgcgcggggtgaattgatgccagggcaaattatcacctttagcgtaacgcctgaaggtgcaacgctaagcaatacaggggaagtccttactgaccagtcaggtcaggccaaagtgacgctgaccagtgacaaagtgaatgtctataccgttacggccataatgggcaaagatgttcccgttcagagccaggtaacggttgcggttaaggcagatgctaaaacggcacatgttgtgagcgtcgtggcttctcctgacaccatcaccgccgacggcatcgatagcagcaccatcacttcacgagtagaagatgattacggattcccggttgaaggtgtcgatattagtcatggcttagacaccaaaggcagcccggtagttaatattccaactacgcgtaccgatcagtccgggcaagtcacggcgacaataaccagtacattggcagaaaccttaacagtcaatgtgcaagttcctggcacagccaaccaatccgcaaccattacattggttgccggcacggccgatgaaagtaagtcaattttgaaatccgatgttgacactctgaaggctgactaccagcagagcgcaaaacttacgctaacattgcaagacaagtacggtaacccgatagtgacgtctgatcatctggaatttgtccagtcaggccccttcgtgaactttctcaagttgagcgatattgattacagccaaagaaattatggcgagtacaccgtgactgtcactggcggaaaagagggaacagcgacactcattcccatgctgaacggggttcatcaggcaaacttaagcatatcgctgaatctcatccaatcgataaaagaaatgtccggtcatgtcactgcaaacaaccataccttctccacggctaaattcccgagcgaaggctttgcaggagcgtattacacactcaacaatgataactttgaagcgggtaaaaccgttgatgattatatgttttcaagttcacagggttgggtgtctgtcgatgcttcgggtaaagtttctttcgcaaatatcggcgatcaaacgtcagtcacaataagcgctgttccccgacaaggaggtacaacctaccagaccttaattaagctgaaaggctggtgggtgaataatggaaatcataccaatatctggctagctgccaatgcgctctgtcatgctaaaaatgatggatataatcttcctggcatcacacatttgacgtctggcgaaaacaaacgcacgcagggatcactgtatggtgaatgggggaacgttggagcgttttccagtaattcgcaatttacaccgggagcttactggacaagtgaatctgatgattacagtcggcactactatgtgcagatgctaaccggtatgaccggaagcgacgctgattccagcccccaactgaccgcctgccgtaaatcactttaa

SEQ ID NO: 394 - DNA, 2805 bp, Escherichia coli 0157:H7
atgattactcatggttgttatacccggacccggcacaagcataagctaaaaaaaacattgattatgcttagtgctggtttaggattgtttttttatgttaatcagaattcatttgcaaatggtgaaaattattttaaattgggttcggattcaaaactgttaactcatgatagctatcagaatcgccttttttatacgttgaaaactggtgaaactgttgccgatctttctaaatcgcaagatattaatttatcgacgatttggtcgttgaataagcatttatacagttctgaaagcgaaatgatgaaggccgcgcctggtcagcagatcattttgccactcaaaaaacttccctttgaatacagtgcactaccacttttaggttcggcacctcttgttgctgcaggtggtgttgctggtcacacgaataaactgactaaaatgtccccggacgtgaccaaaagcaacatgaccgatgacaaggcattaaattatgcggcacaacaggcggcgagtctcggtagccagcttcagtcgcgatctctgaacggcgattacgcgaaagataccgctcttggtatcgctggtaaccaggcttcgtcacagttgcaggcctggttacaacattatggaacggcagaggttaatctgcagagtggtaataactttgacggtagttcactggacttcttattaccgttctatgattccgaaaaaatgctggcatttggtcaggtcggagcgcgttacattgactcccgctttacggcaaatttaggtgcgggtcagcgttttttccttcctgcaaacatgttgggctataacgtcttcattgatcaggatttttctggtgataatacccgtttaggtattggtggcgaatactggcgagactatttcaaaagtagcgttaacggctatttccgcatgagcggctggcatgagtcatacaataagaaagactatgatgagcgcccagcaaatggcttcgatatccgttttaatggctatctaccgtcatatccggcattaggcgccaagctgatatatgagcagtattatggtgataatgttgctttgtttaattctgataagctgcagtcgaatcctggtgcggcgaccgttggtgtaaactatactccgattcctctggtgacgatggggatcgattaccgtcatggtacgggtaatgaaaatgatctcctttactcaatgcagttccgttatcagtttgataaatcgtggtctcagcaaattgaaccacagtatgttaacgagttaagaacattatcaggcagccgttacgatctggttcagcgtaataacaatattattctggagtacaagaagcaggatattctttctctgaatattccgcatgatattaatggtactgaacacagtacgcagaagattcagttgatcgttaagagcaaatacggtctggatcgtatcgtctgggatgatagtgcattacgcagtcagggcggtcagattcagcatagcggaagccaaagcgcacaagactaccaggctattttgcctgcttatgtgcaaggtggcagcaatatttataaagtgacggctcgcgcctatgaccgtaatggcaatagctctaacaatgtacagcttactattaccgttctgtcgaatggtcaagttgtcgaccaggttggggtaacggactttacggcggataagacttcggctaaagcggataacgccgataccattacttataccgcgacggtgaaaaagaatggggtagctcaggctaatgtccctgtttcatttaatattgtttcaggaactgcaactcttggggcaaatagtgccaaaacggatgctaacggtaaggcaaccgtaacgttgaagtcgagtacgccaggacaggtcgtcgtgtctgctaaaaccgcggagatgacttcagcacttaatgccagtgcggttatattttttgatcaaaccaaggccagcattactgagattaaggctgataagacaactgcagtagcaaatggtaaggatgctattaaatatactgtaaaagttatgaaaaacggtcagccagttaataatcaatccgttacattctcaacaaactttgggatgttcaacggtaagtctcaaacgcaagcaaccacgggaaatgatggtcgtgcgacgataacactaacttccagttccgccggtaaagcgactgttagtgcgacagtcagtgatggggctgaggttaaagcgactgaggtcactttttttgatgaactgaaaattgacaacaaggttgatattattggtaacaatgtcagaggcgagttgcctaatatttggctgcaatatggtcagtttaaactgaaagcaagcggtggtgatggtacatattcatggtattcagaaaataccagtatcgcgactgtcgatgcatcagggaaagtcactttgaatggtaaaggcagtgtcgtaattaaagccacatctggtgataagcaaacagtaagttacactataaaagcaccgtcgtatatgataaaagtggataagcaagcctattatgctgatgctatgtccatttgcaaaaatttattaccatccacacagacggtattgtcagatatttatgactcatggggggctgcaaataaatatagccattatagttctatgaactcaataactgcttggattaaacagacatctagtgagcagcgttctggagtatcaagcacttataacctaataacacaaaaccctcttcctggggttaatgttaatactccaaatgtctatgcggtttgtgtagaataa

SEQ ID NO: 395 - DNA, 681 bp, Escherichia coli 0157:H7
atgttagtacttagcgaaagcttcaagaataaattgcttcccatgaatgggtatatgaaaggcggcagcgactccggatctaaagcccaggcacgcgcaactgaaaagggcatcgaactgcagcgtgaaatgtggcagacgaacatgcaaaaccttgcaccgttcacgccactcgctcagcagtacgtatcacagttgcagaatctttcctctcttcaggggcaaggtcaggcgcttaaccagtattacaactctcagcagtataaagaccttgcagggcaggcgcgctatcagagtctggcagcagcagaggcaacgggtggattaggctctacagcaacaggaaaccagttagcagcaatcgcacctacactcggtcaaaactggctgtcaggtcagatgaacaactacaacaatctggcaaatatcggccttggtgctcttacaggtcaggcaaacgccggacagaactacgctaacaatgtcagccaattgtatcaacagcaggcggcagcatcggcagcaaatgcgaataagccttcaggcctacagagttttgctacaggtgccattggtggggccgcatcaggtgcaatgattggtagtgcagttcctgttattgggactggtattggtgctcttgctggcggtgttatcggtggtcttggatcattgttttaa

SEQ ID NO: 396 - DNA, 1071 bp, Escherichia coli 0157:H7
atgaaaaaaatattatcagggttgattctgctgctttgctgtccttatggtttcgccgctaatggtgatggcgcaacgcacatgtcaaatttatcatttggtccgctgacggtggcagcggcgaataaccactccggatacaatattttcgaggcactgagcaacacgactggaacatacccggtgcgctgtcactgtgatgacacgcatggcggaccgggccaacaaacagcattttttcctatcttctacacgggagatgccgcaccggggcttgtgcttgagcgcactcttaatgggttaaattactatgctctgaatgattatttatcggtcggcgtgacgatttttattattaataaccaatatgcggccattccttttgaacacttatccaaccaatccacctcaccgcaacatacctgtggagcaggtaataatgggagcactgtaaatctggattcagggcgctcggcaaaattatctttctatgttcggcattctattactggcacggtgacaatacccacaacggaagtcgcctggttgtacgcgggcatgtccgatcattttcccaaaacgacccccgtttctaaagtgacaattcgcggacaactaacggccccgcagaactgtgagttaacgccaaatcagagcatcgatgtcgattttcaaaaaattaatagcgctgagttctcctcaacggcgggttcaattattgcagaaagaaagattaaaaccgaagtcacagtatcctgtaccgggatggaagacgtaaggtccacggaggtggtgagtgcgtcgatgattgcggcaaacagaagtgccgatgccaccatgatcgtgacgagtaatccggatgtgggaattaagatttttgataagaacgaccgtccagtgaatgtggatgggggcaacttacccgctgatatgggtgctattagtcgattaggaaaaaccgatggtagcgtaacgttttattcagcgcccgccagtctgacgggcgcaaaaccagcgcctgataatggatttaccgctacagccacgctggttattgaatttactaactaa

SEQ ID NO: 397 - DNA, 3984 bp, Escherichia coli 0157:H7
atgaataaaatatatcggctaaagtggaacaggtcccgtaactgttggagcgtctgctcggagctggggagcagagtaaaaggaaaaaagtcccgggctgttttaattagcgcgataagtttatattcatctctggtattcgccgatgatgtcatcgtaaaccaggataaaactattgattttggcaaagagaaccagagcatcgattaccgtattacggtgacagacaatgccaatctggtaatcaatgcgacagatacttcccgtccgcgtctgactctcgcttctggtggtgggttggatattaccggaggaaaggtaacaatcaatggcccacttaactttttgctgaaaggtacggggttcctgaatgtctccaatgctggcagcgagttatatgctgatgatttgtatgaatcaaactcaggcatgagacacgatcgcggctattttaatgtctccaacggcggcaaaatccatgttaagggcaccagccgtctgacctatttgcagggaaatgtcagtggtgaaggtagccaggtaaattccgaaaccttctttatgggcgtttacggcagttacggtggtaatcagtacctgtcagttaataacggcggtgaagttaatgccaggaagcaaattagcctgggctattatgatcaagtctccgatacaacacttgctgtttcggaaggtggtaaaatttctgcgcctactattagtttaagcaccaactctgagttagcgttaggggcacaggaaggaagcgcagcgaaggcagcagggattattgatgccgaaaaaattgagtttgtgtgggcaaagacatccgagaagaaaatcaccttaaaccacacggataaagacgcgactatttccgcggatattgtcagtggcagcgagggcctgggctatatcaatgcgctcaatggcacgacttacttaaccggtgataactctgcctttagtggtaaagtcaaaattgagcaaaatggcgctttagggatcacccaaaatataggtacagcagagatcaacaaccgcgggaaattacacctgaaggctgacgatagcatgacctttgccaataagatctctggcaacggtacaataagtatcgacagtgggacggtggagttgaccggcaataactatgcattcagcggatatattgatgttgcttctggtgctgtcgctgttatttctgaagacaagaatatcggtcgtgcagagctggatgtcgatggcaaattgcaaattaatgccaacaaagattgggtatttgataacgatcttgaaggtagaggcattgttgaaataaacatggggaatcacgaattctccttcgatgagtttgcttatacagactggttccagggttcactggcgttccagaacacgacatttaatctggaaaagaatgctgagtttctgcagaaaggcgggatcactgcgggtcagggaagcctggtaacagtgggtaagggcgctcactccattagcactttgggattctccggcggaaccgttgattttggtgccctgacagcaggtgcacagatgacagaagggacggtcaacgttagtaaaacgctggatttgcgcggcgagggtgtgattcaggtttctgacagtgacgttgtccgctcagtatctcgtgatattgactctgcgttatcgctcactgaagtcgatgatggtaacagcaccattaagttggttgatgcgcaaggtgcggaagttctgggcgatgcgggcaatctgcaattgcaggataaaaatgggcaaatcctctccagcagcgcccaacgtgatattcagcagaatgggcaaaaagcggccgtcggcacttacgactatcgtctgacgagtggggtaaacaatgacggtctgtatattggttacggcctgacccagcttgatttacacgctaccgacagcgatgctctggtgctgagctctaacggtaaaagcgagaatgccgccgatctcagcgcaaagattaccggcagtggtgacctggcattcagcagccagaagggtcagaccgtatcgctttctaacaaagacaacgactataccggtgttaccgatctgcgcagtgggacgcttttgttgaataacgataacgtgttgggtaatacccatgaactgcgtctggcggcagagactgaactggacatgaatggtcacagccagaccgtgggcacgctcaatggcagcgccgattcactgctgagcttaaatggcggcagtctgacggttaccaacgggggcacttcaaccggttcgttaacggggagcggagagctgaatattcagggcggcacgctggacatcgcgggcgataacagcaacctgacggcgaatgtgaacattgctaattcggctaatgtcctggtaagtcatgcgcagggattgggtagcgcaaacgttgagaacaacggtaccctggcgttgaataatagcgctgaaaaaagagcggctgcgtctgtgaattacgccctgggcggcaatctgaccaacaacggtacgctgatgaccggaatgtcaggacagcaagctggcaatgtgttagtggtgaaggggaactaccacggtaataacggtcaactagtaatgaatacggtactgaatggcgatgactcagtaaccgataaattggttgtcgagggcgatactagcggcacgactgccgttacggtgaataacgctggcggtacaggtgcgaaaacccttaacggtatcgaacttatccatgtagacggtaagtctgagggcgaatttgttcaggctgggcgtatcgttgcgggggcgtatgactacactctcgcgcgtggacaaggggcaaatagtggtaactggtatctgaccagcggcagtgattctcctgaactgcagccggagccagacccgatgccgaatccagagccaaacccgaatccagagccgaaccctaacccgacacctacgccgggtccggatctgaatgtggataatgacctgcgaccggaggcgggtagctacattgcgaaccttgcagcagcgaataccatgttcaccacgcgtctgcatgagcgtctgggtaatacgtactataccgacatggtgacgggtgagcagaaacaaaccactatgtggatgcgccatgaaggtggtcataataaatggcgtgatggcagcggccagctgaaaacccaaagcaatcgctatgttctgcaactgggaggcgatgtcgcgcagtggagccaaaacggcagcgaccgctggcatgttggggtcatggcgggatatggcaacagcgacagcaaaaccatttcctcgcgaaccggttatcgtgcaaaagcgagtgtgaacggatatagcacaggcctctatgccacctggtatgccgatgacgagtcgcgtaatggcgcgtatctcgacagttgggcgcagtacagctggtttgataacacagtgaaaggggatgacttacaaagtgaatcctataaatcaaaaggatttaccgcttcactggaagctggatacaaacacaaattagctgaatttaatggcagccagggaacgcgtaatgaatggtatgttcagccgcaagcacaggttacctggatgggagtcaaagccgataagcaccgcgaaagcaacggaaccctcgttcatagcaacggtgatggcaatgttcaaacccgacttggcgtaaaaacctggctgaagagccaccataaaatggatgacggtaaatcccgcgagttccagccgtttgtagaagtgaactggctacataacagtaaggatttcagcaccagtatggatggcgtgtctgtcactcaggatggagcccgaaatattgctgagataaaaaccggggtggaaggacagctaaatgccaacctgaatgtctgggggaatgtgggcgttcaggttgccgataggggatataatgacacctctgcaatggttggcattaagtggcaattctga

SEQ ID NO: 398 - DNA, 549 bp, Escherichia coli 0157:H7
atgataacgatgaaaaaaagtgtattgacggcgtttataactgtggtatgtgcaacgtccagcgttatggctgctgatgataatgctatcacggatggctcagtaacatttaatggtaaagttattgctccagcttgtaccctggtagctgcgacgaaagattccgtggtgactttgccagatgttagtgccacgaagttgcaaaccaatggtcaggtttctggcgtgcaaactgatgtgccaattgaattaaaagattgtgatactaccgtaacaaaaaatgcaacgttcacctttaatggcactgcggatactactcagattacagcgtttgctaaccaggcctcatctgatgctgctacaaacgtggccctgcaaatgtatatgaatgatggtacaacggccatcaagccagacacagaaaccgggaacattttgttgcaagatggagatcagacgttgacttttaaagttgattatatcgctacggggaaagcgacttctggtaatgtgaatgcggtaacaaatttccatattaactattattaa

SEQ ID NO: 399 - DNA, 564 bp, Escherichia coli 0157:H7
atgagtaagtttgtaaaaacagctattgctgcaacaatggtaatgggtgcgttcgcttctacttcaacaatcgccgctggcaacaatggtacagcacgtttctacggcaccattgaagattccccgtgctctatcgttcctgatgatcacaaactggaagttgatatgggtgacattggttcagggatcctgaaaaataacgggacttctacaccgaaagctttccagatccatctgcaagactgtgtgtttgacacccagacaacgatgaccactaccttcaccggtaacgcgtcttctaccaacagcggcaattactacaccatttacaataccgatactggtgcggcatttaacaatgtcagcctggccattggtgacgctcagggaacctcttataaaagcggcgcgggtatcgaacagaaaatcgtaaacgatacggcgaccaacaaaggcaaagcgaagcagacgctggactttaaagcctggctggtgggcgctgctgatgcgccagatttaggtaattttgaagccaacacgaccttccagattacttatctctaa

SEQ ID NO: 400 - DNA, 3753 bp, Escherichia coli 0157:H7
atgcgggttatctttctacgcaaggagtatttatctctactcccgtcaatgattgcatctcttttctctgctaacggtgtcgcggcggccattgatttatgccagggatatgatatcaaagcgagttgtcacgccagcaggcaaagcctttcaggcattacgcaggtctggagtattgccgatgggcaatggctggttttttcggatatgaccaataatgccagcggtggggccgtatttttgcaacaaggagcggaatttacattatcaccagaaaatgaaactggaatgactctgtttgccaataacaccgtttcaggagaatataataacggcggggcaatatttgctaaagaaaactcaacgctgaatcttacggatgttattttttctggtaacgtcgcaggcggctatggtggcgcaatctattcttctggtactaacgataccggtgccatcgatttacgtgtcactaacgccgtgtttcgcaataacatcgctaatgacggcaaaggtggtgcaatttataccatcaataatgatatctatttaagtgatgatgtttttaacaataaccaggcatatacatcaacaagttacagtgatggcgatggcggcgcaatcgatgtcacagataataatagcgacagcaagcatccttcaggttatacgataataaataacactgcctttacaaataacactgccgaaggttatggcggggcgatatataccaatagcgcgacggctccctatcttattgatatttctgttgatgacagctacagccagaacggaggcgtgttagtcgatgagaacaatagcgcagcaggctatggagatggtccttcctctgcggcgggtggctttatgtatctcggcttaagtgaagttacctttgatattgccgacggaaaaacgctggttattggcaatacagagaatgacggagctgttgactctattgctggtaccgggttaatcaccaaaacaggttccggcgatctggtacttaatgcagataacaatgactttactggtgagatgcagattgaaaacggtgaagttaccctgggccgcagcaactccctgatgaatgtcggcgatacgcattgccaggacgatccgcaagactgctacggtctgacgatagggagtattgataagtaccagaatcaggcagagctaaatgttggctccacccaacaaacctttgcgcactcattgacgggctttcagaatggcactttaaatatcgatgctggtggcaatgttactgttaatcaaggcagttttgctggcaccatcgaaggtgctggtcagctcaccattgcgcaaaacggcagctatgtgctggcgggggcgcagtcgatggcgctaaccggcgatatagtggtggatgctggtgcggtgctttcgctggaaggcgacgcggcagatcttgccgctctccaggacgatccgcagtcgatcgtgttaaacggcggtatgctcgatctctctgatttctccacctggcagagcggtacatcatacaaagatggccttgaagtcagtggcagcagcggaacggttatcggcagtcaggatgtggtagatcttgcaggcggaaacgatatgcatatcggcggcgacgggaaagatggcgtctacgtggtgatcgatgcgggtgacgggcaggtcagcctggcaaatgacaatcaatacctcggcacaacgcaaatcgcttccggtacgctgatggtgagcgacaactcgcagcttggatatacccattataaccgccaggttatctttaccgataagccacaagaaagcgtgatggagattactgccaatgtcgatactcgctctacaacgactgagcatgggcgtgatattgaaatgcgcgccgacggtgaagtggcagttgatgcgggggtagacacgcagtggggcgcactgatggctgacagcagcgggcagcatcaggatgagggtagcacattgactaaaacgggggcgggtacactggagctgaccgccagcggtacaacgcagtcagcggtgagagtagaagagggcacgctgcaaggtgatgttgcggatatcttcccttatgcttcgtcgctatgggtcggtgacggggcaacgttcgttactggcgcggatcaggatattcagtcaattgatgctacttccagcggcactatcgacatcagcgatggtacggttttgcgcctgaccgggcaggatacttccgtcgcccttaatgcctcactgtttaactgcgatgggacgctggtgaatgccaccgatggtgtgacgttgacaggtgagcttaataccaaccttgaaactgacagcctgacttatctttccaacgtgacggttaatggcaatctgaccaatacgtccggtgcggttagcctgcaaaatggcgtcgctggcgatacgctgacggtaaacggtgattataccggcggcggtacgctactgctcgatagcgaattaaacggcgatgactcggtaagcgatcaattggtgatgaacggtaatactgctggcaacacaactgtggtggttaactccattacagggattggtgagccgacatcgacaggcattaaagtggttgatttcgcagctgatcccacgcagtttcaaaacaatgcgcagttcagtctggcaggcagcggctacgtcaatatgggagcgtatgactacacgctggtggaagataacaacgactggtatctgcgatcgcaagaagtaacgccgccatcgccacctgatccagacccgactcccgatcctgatcccacgcaggatcctgatccaacacccgacccggaacctacgcctgcttaccagccggtgttgaatgccaaagttggcggttatctcaataacctgcgggcggcaaatcaggcgtttatgatggagcgacgcgatcacgcaggtggcgatggtcagacgctgaatttacgtgttatcggcggagattatcattacacagcagcggggcaactggctcaacatgaagacacttctacggtgcaacttagcggcgatctgtttagcgggcgctggggcacggatggcgagtggatgcttgggattgttggtggctacagcgataaccagggcgacagccgctcgagtatgaccggaactcgcgccgataaccagaaccacggttatgcggttgggctgacctcaagctggtttcagcacggtaagcagaagcagggggcctggctggataactggttgcagtacgcgtggtttagcaatgatgtttctgaacatgaagatggcgtggatcattaccattcgtcggggattatcgcctcgctggaagcggggtatcagtggttaccggggcgtggtgtggtgattgaaccgcaggcgcaggtgatttatcagggcgtgcagcaggatgattttaccgccgctaaccgtgcgcgcgtgtcacaatcgcagggtgatgatattcagacgcggctgggtttacacagcgaatggcgtaccgctgttcatgtcataccaacattagatctgaattattatcacgatccccattcgacggaaattgaagaagatgccagcactatcagtgacgatgcggtgaagcaacggggtgaaataaaagtgggagtcacgggcaatatcagtcagcgagtttcgctgcgtggtagcgtggcgtggcagaaagggagtgatgattttgcccagacggcagggtttttgtcgatgacggtgaaatggtaa

SEQ ID NO: 401 - DNA, 2943 bp, Escherichia coli 0157:H7
atgcactcctggaaaaagaaacttatagtatcacaattagcattggcttgcactctggctatcacctctcaggctaatgcagcgaccaacgatatttctggtcaaacttacaatactttccatcactacaacgacgccacctatgctgatgacgtttactatgatggttatgtaggctggaacaactatgccgctgatagctattacaacggcgatatctacccggtcattaataacgctaccgttaacggcgtgatttctacctactatctggacgacggtatttctaccaataccaacgccaatagtctgacaatcaaaaacagcactattcacggtatgattacctctgagtgcatgactactgattgtgctgatgaccgtgctactggttatgtttatgatcgtctgacactgagcgttgataattcaacgatcgatgacaactacgagcattatacttacaacggtacctataataatgccgctgacactcatgttgtagatgtttacgatatgggtactgctattacactggatcaggaagttgatctgtccatcactaataactctcatgtagcaggtattacgctgactcagggttatgagtgggaagatattgacgacaacacagtcagcactggcgtaaacagcagcgaagtgtttaataacactattactgttaaagattctactgtgacctctggttcatggactgatgaaggtactactggttggtttggccatactggtaatgccagcaactatagcaacacgctgactgcagacgatgttgcaattgccgcaatcgcaaatccgtatgctgataatgcgatgcagactacagtaactttagacaactcaacactgatgggtgatgttgttttctccagtaatttcgatgaaaacttcttcccgcaaggtgctaacagctatcgcgatgctgatggtgatgtagataccaacggttgggatggcacagaccgtatggatgtgactctgaacaacggcagcaagtgggttggcgctgcaatgtctgttcatatggttgatgaagatggtgatggttcttacgacggatatgctgttggtactgaagcaactgcaactctgctcgatattgcagctaacagcctgtggccttcatcaactgtcggtgttgataacatcaatactcaatatgacgaaaatggccatatcgtaggaaacgaagtttaccagagcggtttgtttaatgtgactttgaacggtggttcagagtgggatacaacaaaatcttctctgattgatactttaagtattaacagcggttcccaagttaatgttgcagactctcgtctgatctctgacactgtctctctgactggcggttctaacctgaacatcggtgaagacggtcatgtagcgactaataccctgaccatcgacaatagtaccgttaaaatgtctgatgatgtttctgcgggctggggtttagaagatgctgcactgtacgcaaataccatcaccgtaactaacgacggtctgttggatattaacgttgatcagttcgatgctaacccgttccaggccgataccctgaatctgaccagtaccactgatactaacggcaacattcacgctggtgtattcgatatccatagcagtgattacgtaatggataccgatctggtcaacgatcgtaccaacgatactaccaagtcaaactacggttatggcttaatcgcaatgaactctgatggtcacctgactattaacggtaacggcgataacgacaacactgcttctatcgaagctggtcagaacgaagttgataacaacggtgaccatgttgcagccgcgaccggtaactacaaagttcgtatcgacaacgctactggtgctggttctatcgctgactacaacggcaacgagctgatctacgtcaacgacaaaaacagcaacgcgaccttctctgctgctaacaaagctgacctgggtgcatacacctatcaggctgaacagcgcggtaacaccgttgttctgcaacagatggagttgaccgactacgctaacatggcgctgagcatcccatctgcgaacaccaatatctggaacctggaacaagacaccgttggtactcgtttgaccaactctcgtcatggcctggctgataacggcggcgcatgggtaagctacttcggtggtaacttcaacggcgacaacggcaccatcaactatgatcaggatgttaacggcatcatggtcggtgttgataccaaaattgacggtaacaacgctaagtggatcgtcggtgcggctgcaggcttcgctaaaggtgacatgaatgaccgttctggtcaggtggatcaagacagccagactgcctacatctactcttctgctcacttcgcgaacaacgtctttgttgatggtagcttgagctactctcacttcaacaacgacctgtctgcaaccatgagcaacggtacttacgttgacggtagcaccaactccgacgcttggggcttcggtttgaaagccggttacgacttcaaactgggtgatgctggttacgtgactccttacggcagcatttctggtctgttccagtctggtgatgactaccagctgagcaacgacatgaaagttgacggtcagtcttacgacagcatgcgttatgaactgggtgtagatgcaggttataccttcacctacagcgaagatcaggctctgactccgtacttcaaactggcttacgtctacgacgactctaacaacgataacgatgtgaacggtgattccatcgataacggtactgaagggtctgcggtacgtgttggtctgggtactcagttcagcttcaccaagaacttcagcgcctataccgatgctaactacctcggtggtggtgacgtagatcaagactggtccgcgaacgtgggtgttaaatatacctggtaa

SEQ ID NO: 402 - DNA, 564 bp, Escherichia coli 0157:H7
atgaaactcaaacatgttggtatgattgtcgtttctgtgttggcgatgtcgtctgctgcggtaagcgcagccgagggtgatgaatcagtaacgaccactgttaatggcggtgttattcattttaaaggtgaagtggtaaatgccgcttgtgcgattgattccgaatcaatgaaccaaacggttgagctgggtcaggttcgttcttctcgcctggctaaagcgggtgacctcagctccgccgttggcttcaatatcaagctgaatgattgtgataccaatgtttccagtaatgcagctgttgcattcctgggtactactgtcaccagtaatgacgatacgttagcgctgcagagttcagcggcaggctctgcccaaaatgtcggtattcaaattttggaccgtacgggtgaggtattaatacttgatggggccacttttagtgctaaaaccgacttgattgatggcacgaatatactaccattccaggctcgttatattgctctcgggcagtccgtagctggtactgcaaacgcagatgcgaccttcaaagttcaatatctataa

SEQ ID NO: 403 - DNA, 459 bp, Escherichia coli 0157:H7
atgaaacttttaaaagtagcagcaattgcagcaatcgtattctccggtagcgctctggcaggtgttgttcctcagtacggcggcggtggcggtaaccacggtggtggcggtaataacagcggcccgaattcagagctgaatatttatcagtacggtggtggtaactctgcacttgctctgcaagctgatgctcgtaactctgatcttactattacccagcatggtggtggtaacggtgcagatgttggtcagggctcagatgacagctcaatcgatctgacccaacgtggctttggtaacagcgccactcttgatcagtggaacggtaaagactctcatatgacagttaaacaattcggtggcggcaacggtgcagcggttgaccagactgcatctaattccaccgtcaacgtaactcaggttggctttggtaacaacgcgaccgctcatcagtactaa

SEQ ID NO: 404 - DNA, 1677 bp, Escherichia coli 0157:H7
atgcctattggtaatcttggtcataatcccaatgtgaataattcaattcctcctgcacctccattaccttcacaaaccgacggtgcaggggggcgtggtcagctcattaactctacggggccgttgggatctcgtgcgctatttacgcctgtaaggaattctatggctgattctggcgacaatcgtgccagtgatgttcctggacttcctgtaaatccgatgcgcctggcggcgtctgagataacactgaatgatggatttgaagttcttcatgatcatggtccgctcgatactcttaacaggcagattggctcttcggtatttcgagttgaaactcaggaagatggtaaacatattgctgtcggtcagaggaatggtgttgagacctctgttgttttaagtgatcaagagtacgctcgcttgcagtccattgatcctgaaggtaaagacaaatttgtatttactggaggccgtggtggtgctgggcatgctatggtcaccgttgcttcagatatcacggaagcccgccaaaggatactggagctgttagagcccaaagggaccggggagtccaaaggtgctggggagtcaaaaggcgttggggagttgagggagtcaaatagcggtgcggaaaacaccacagaaactcagacctcaacctcaacttccagccttcgttcagatcctaaactttggttggcgttggggactgttgctacaggtctgatagggttggcggcgacgggtattgtacaggcgcttgcattgacgccggagccggatagcccaaccacgaccgaccctgatgcagctgcaagtgcaactgaaactgcgacaagagatcagttaacgaaagaagcgttccagaacccagataatcaaaaagttaatatcgatgagctcggaaatgcgattccgtcaggggtattgaaagatgatgttgttgcgaatatagaagagcaggctaaagcagcaggcgaagaggccaaacagcaagccattgaaaataatgctcaggcgcaaaaaaaatatgatgaacaacaagctaaacgccaggaggagctgaaagtttcatcgggggctggctacggtcttagtggcgcattgattcttggtgggggaattggtgttgccgtcaccgctgcgcttcatcgaaaaaatcagccggtagaacaaacaacaacaacaactactacaactacaactacaagcgcacgtacggtagagaataagcctgcaaataatacacctgcacagggcaatgtagatacccctgggtcagaagataccatggagagcagacgtagctcgatggctagcacctcgtcgactttctttgacacttccagcatagggaccgtgcagaatccgtatgctgatgttaaaacatcgctgcatgattcgcaggtgccgacttctaattctaatacgtctgttcagaatatggggaatacagattctgttgtatatagcaccattcaacatcctccccgggatactactgataacggcgcacggttattaggaaatccaagtgcggggattcaaagcacttatgcgcgtctggcgctaagtggtggattacgccatgacatgggaggattaacgggggggagtaatagcgctgtgaatacttcgaataacccaccagcgccgggatcccatcgtttcgtctaa

SEQ ID NO: 405 - DNA, 561 bp, Escherichia coli 0157:H7
atgttttctactttcaaaaaagcagctctgctggcagctattgcattacctttttcaactatggctgcgcctacagtcacttttcagggtgaagtaaccgatcagacctgttccgtaaatatcaacggtcaaaccaattcagtagtattgatgccgaccgtagccatggctgacttcggtgcaactttagctgatggtcagagcgcaggccagacgccgtttacggtttctgtgtctaactgccaggctccaactggtgcagatcaggcaatcaacaccaccttcctgggctacgacgttgacgctagcacgggtgttatgggaaaccgtgataccagcagcgatgcggcgaaaggctttggcattcagttaatggattccagcacttctggtaacccagtaactctggctggcgcgactaacgtaccgggtctgaccctgaaagttggcgataccgaagccagctacgacttcggtgcgcgttacttcgttatcgatagcgctgctgccactgccggtaaaattaccgctgtcgcagaatacaccctgagctacctctaa

SEQ ID NO: 406 - DNA, 1401 bp, Escherichia coli 0157:H7
atgaacagtgaaggaggaaaaccggggaatgtactgaccgttaacggcaactataccggaaacaatggcctgatgacgttcaacgcgacgctgggcggcgataattcacccaccgataagatgaacgtgaaaggcgatacccaagggaacactcgcgttcgggttgataacattggcggcgtcggtgcgcaaacggtcaacggtattgaactcattgaggttggcggtaattctgcaggtaatttcgcgctgaccaccggaactgtcgaagctggggcttacgtctacacgctggctaaagggaaggggaatgacgagaaaaactggtatctgaccagtaaatgggacggcgtaacgccagcggatacacccgatcccatcaataatccccctgttgtggatccggaaggcccatcagtttatcgcccggaggccggaagctatatcagcaacattgccgcagccaactcgctgtttagccatcgcttacacgaccgtctgggtgagccgcaatatacagattcactgcattctcaggattcagcaagcagtatgtggatgcgtcatgtcggggggcacgaacgttccagtgccggagacggccagctaaatactcaggctaaccgctatgtattgcagctaggcggcgatttggcgcagtggagtagcaacgcgcaggatcgctggcatcttggcgtgatggcaggctacgccaatcagcacagtaatactcagagtaatcgtgtgggttataaatcggatgggcgcatcagcggttacagcgctgggctgtacgcgacctggtatcagaacgatgcgaataagaccggcgcttatgttgacagctgggcgctgtataactggtttgataacagcgtcagttccgataaccgttctgctgacgactatgattctcgcggtgtgacggcctctgttgagggtgggtatacctttgaagcgggaacatgtagcggcagcgaagggacgctgaatacctggtacgtccagccacaggcgcaaatcacctggatgggtgtgaaagattctgaccatgcccggaaagacggaacgcgcattgaaacggaaggcgacggaaacgtgcaaacgcgacttggggtgaaaacctacctgaatagccatcaccagcgtgacgatggtaaacagcgtgagttccagccttacattgaagcgaactggatcaacaatagcaaagtctacgccgtgaagatgaatggtcaaaccgtaagccgtgatggtgcgcgaaatctcggtgaagtacgtaccggggttgaggcgaaagtaaataacaaccttagcctgtgggggaatgtcggtgtgcaactaggtgataaaggctatagcgatactcagggcatgctgggagtgaaatatagctggtaa

SEQ ID NO: 407 - DNA, 2637 bp, Escherichia coli 0157:H7
atgtcatatctgaatttaagactttaccagcgaaacacacaatgcttgcatattcgtaagcatcgtttggctggtttttttgtccggctctttgtcgcctgtgcttttgccgtacaggcacctttgtcatctgccgaactctattttaatccgcgctttttagcggatgatccccaggctgtggccgatttatcgcgttttgaaaatgggcaagaattaccgccagggacgtatcgcgtcgatatctatttgaataatggttatatggcaacgcgtgatgtcacatttaatacgggcgacagtgaacaagggattgttccctgcctgacacgcgcgcaactcgccagtatggggctgaatacggcttctgtcgccggtatgaatctgctggcggatgatgcctgtgtgccattaaccacaatggtccaggacgctactgcgcatttagatgttggtcagcagcgactgaacctgacgatccctcaggcatttatgagtaatcgcgcgcgtggttatattcctcctgagttatgggatcccggtattaatgccggattgctcaattataatttcagcggaaatagtgtacagaatcggattgggggtaacagccattatgcatatttaaacctacagagtgggttaaatattggtgcgtggcgtttacgcgacaataccacctggagttataacagtagcgacagatcatcaggtagcaaaaataaatggcagcatatcaatacctggcttgagcgagacataataccgttacgttcccggctgacgctgggtgatggttatactcagggtgatattttcgatggtattaactttcgcggcgcacaattggcctcagatgacaatatgttacccgatagccaaagaggatttgccccggtgatccacggtattgctcgtggtactgcacaggtcactattaaacaaaatgggtatgacatttataatagtacggtgccgccggggccttttaccatcaacgatatctatgccgcaggtaatagtggtgacttgcaggtaacgattaaagaggctgacggcagcacgcagatttttaccgtaccctattcgtcagtcccgcttttgcaacgtgaagggcatactcgttattccattacggcaggagaataccgtagtggaaatgcgcaacaggaaaaaccccgctttttccaaagtacattactccacggccttccagctggctggacaatatatggtggaacgcaactggcagatcgttatcgtgcttttaattttggtatcgggaaaaatatgggggcactgggcgctctgtctgtggatatgactcaggctaattccacacttcccgatgacagtcagcatgacggacaatcggtgcgttttctctataacaaatcgctcaatgagtcaggcacgaatattcagttagtgggttaccgttattcgaccagcggatattttaatttcgctgatacaacatacagtcgaatgaatggctacaacatcgaaacacaggacggagttattcaggttaagccgaaattcaccgactattacaacctcgcttataacaaacgcgggaaattacaactcaccgttactcagcaactcgggcgctcatcaacactgtatttgagtggtagccatcaaacttattggggaacgagtaatgtcgatgagcaattccaggctggattaaatactgcgttcgaagatatcaactggacgctcagctatagcctgacgaaaaacgcctggcaaaaaggacgtgatcagatgttagcgcgtaacgtcaatattcctttcagccactggctgcgttctgacagtaaatctcagtggcgacatgccagtgccagctacagcatgtcacacgatctcaacggtcggatgaccaatctggctggtgtatacggtacgttgctggaagacaacaacctcagctatagcgtgcaaaccggctatgccgggggaggcgatggtaatagcggaagcacaggctacgccacgctgaattatcgcggtggttacggcaatgccaatatcggttacagccatagcgatgatattaagcagctctattacggagtcagcggtggggtactggctcatgccaatggcgtaacgctggggcagccgttaaacgatacggtggtgcttgttaaagcgcctggcgcaaaagatgcaaaagtcgaaaaccagacgggggtgcgtaccgactggcgcggttatgccgtgctgccttatgccactgaatatcgggaaaatagagtggcgctggataccaataccctggctgataacgtcgatttagataacgcggtcgctaacgttgttcccactcgtggggcgatcgtgcgagcagagtttaaagcgcgcgttgggataaaactgctcatgacgctaacccacaataataagccgctgccgtttggggcgatggtgacatcagagagtagccagagtagcggcattgttgcggataatggtcaggtttacctcagcggaatgcctctagcgggaaaagttcaggtgaaatggggagaagaggaaaatgctcattgtgtcgccaattatcaactgccaccagagagtcagcagcagttattaacccagctatcagctgaatgtcgttaa

SEQ ID NO: 408 - DNA, 981 bp, Escherichia coli 0157:H7
atgcagataatctttggagaaaaatgcgtgtcattactacgactattttttgccgccgtcttaatgctatggtgcgctcaaaccgctgcttatagcgggcagtgtcataccactcaggggaatccgtatattggcgtcaattttggcgttaaaaccctggaggaagaagaaaatacgactggggtagtaaaagacaaattttatcagtggaacgaatcgaatgattattatgtttcctgtgattgcgataaagacaatgtcagaagtggccgatgggcattcgccgcggattcaccgttagtctatttaggcgacaactggtacaaaattaatgactatcttgccgccaaagttttattgcaggttaaaggcagttctcctacagcggttcctttcgaaaacgtggggactggggcagatacccggtggcatatttgtgaccccggcggtcaacgtttaggcggccagggagctagcggtaatagcggtagcttttccctgaaaatattgcagccgttcgttggttcggtcgtcattcctcctatggcgctggcgcgattatttgaatgctacaacatacccgcaggtgattcctgcacgactacaggcacaccggttttagtgtattacctgtctggtactatcaattcacttggctcatgttccgtcaatgccggagaaacaatcgaggtcgatctgggcgacgtatttgcggctaactttcgtgttgtagggcataagcctcttggggccagaacggcagaacttgcaattccagtcaggtgtaacacgggaaacgcggggttagttaacgtcaacctgagtctgacggcaaccacagaccccagctatccccaggcgattaagacgtcacgtcctggcgtgggcgtggtggtgaccgatagccagaacaacattatttcccctgctggtggaacattaccgctctctattcctgatgatgcagacagtatcgcgtga

SEQ ID NO: 409 - DNA, 549 bp, Escherichia coli 0157:H7
atgaaaattaaaactctggcaatcgttgttctgtcggctctgtccctcagttctacagcggctctggccgctgccacgacggttaatggtgggaccgttcactttaaaggggaagttgttaacgccgcttgcgcagttgatgcaggctctgttgatcaaaccgttcagttaggacaggttcgtaccgcatcgctggcacaggacggagcaaccagttctgctgtcggttttaacattcagctgaatgattgcgataccaatgttgcatctaaagccgctgttgcctttttaggtacggtgattgatgcgggtcataccaacgttctggctctgcagagttcagctgcgggtagcgcaacaaacgttggtgtgcagatcctggacagaacgggtgctgcgctgacgctggatggtgcgacattcagtgagcaaacaaccctgaataacggtactaacaccattccgttccaggcgcgttattatgcaatcggcgaggcaaccccgggtgctgctaatgcggatgcgaccttcaaggttcagtatcaataa

SEQ ID NO: 410 - DNA, 606 bp, Escherichia coli 0157:H7
atgaaattaaaagtcatcgctacactgattgctactgttgccgtgggtgtaagctttaacagcaattttgcttctgcgagtacaacgtccgcttctttaaccgtaaacagtaacctgactatgggtacctgcagtgctcagataatggataatagtaataaagtgatcaatgaagtggtctttggcaatgtttatatttctgaactcggtgcaaaaagcaaagtgcaacagtttaaaattcgctttagcaattgctctggccttccccaaaacagcgcccaaatagtgctggcacctaatggtatatcctgtgctggttctcaatcgtcatcggcgggtttttctaacaagtttactgacgctagcgcagcaaccagaacggctgtggaagtatggactacagatacaccggaaagcaatggcagtacgcaattccattgtgctcaaaagataccagtgcctgtgacgcttcccgccgacaccacaactcagccttacgattacccgttaagtgcacggatgaccgttgcggaaggtagattggtaaccgatgtaagaccgggtaatttccgctctcccacgactttcacgatcacttatcagtaa

SEQ ID NO: 411 - DNA, 2511 bp, Escherichia coli 0157:H7
ttggcatcaacagttgagtatggtgagacagttgatggtgttgtcctggaaaaagatatccagctggtttatgggaccgccaataatacgaaaatcaatcctggcggagaacagcatattaaagaatttggtataagtagtaatactgaaattaacggcgggtatcagtacattgaaatgaatggcaccgcagaatactcagtattaaatgatggttatcaaattgttcaaatgggtggcgcggcaaaccagactacgctcaataatggtgtgctacaggtttatggcgcagcgaatgatcccacgattaaaggcgggcgcttaatcgttgaaaaagatgggattaccgtccttgccgctatcgaaaagggaggattactggaggttaaagaggggggattagcgattgcggtagatcagaaagcaggcggtgctattaaagcaagcacgcgggtcatggaggtattcggaacaaaccgtctcggtcagttcgaaatcaagaatggtattgctaacaatatgctgttggaaaacggcggaagtttgcgagttgaagaaaatgacttcgcttataatactactgtagatagtggcggcttactggaggttatggatggcgggactgcaactggcgttgataaaaaagcaggcggaaaattaattgtctcaacgaatgcgctggaagtgagtggtacaaacagtaaaggccaatttagtataaaagatggtgtgtcaaaaaattatgaactggatgatggttccgggcttattgttatggaggacacgcaggccattgacactatcctcgatgagcatgccactatgcaatcgctgggaaaggatactggtacgagagtgcaggcaaatgcggtatatgatctcggtcgatcagatcagaatggaagtataacgtattcctctaaagccatctctgaaaatatggttatcaacaatggccgcgctaacgtctgggctggcacaatggttaacgtgtcagtcagaggaaatgatggcattcttgaggttatgaagccgcaaataaattatgcacccgcaatgttggtgggtaaggtagtggtttctgagggcgcttctttaagaacgcatggtgccgtggataccagcaaagcggatgtttcgctcgaaaatagcgcatggaccatcattgccgatatcactacgacgaaccaaaacacccgccttaacttagccaaccttgcgatgtctggcgcaaatgtgattatgatggatgagtcagtgactcgttcatctgtgacggcaagtgcggaaaatttcactacgttgaccaccaataccctgtcgggaaacggcaatttttatatgcgtaccgatatggcgaatcatcagagcgatcagctcaacgtcaccggtcaggcaacaggtgatttcaaaatattcgtgacggacaccggtgccagcccggcagcaggagatagccttacactggtaacaacgggcggcggtgatgctgcatttacgttgggcaatgccggaggcgttgttgatatcggtacgtatgaatataccttgctggataatggtaaccatagctggagtctggcagagaatcgcgcgcaaattaccccttcaaccactgatgtgctgaatatggcggccgcacaaccgctggtatttgatgcagaactggacaccgtgcgtgagcgtcttggtagcgtaaaaggcgttagttacgatacggcgatgtggagttcggcaattaacacccgcaacaacgtgaccactgatgcgggagctggttttgagcaaacattgacgggcctgacgctcggtatcgatagccgtttctcccgtgaagaaagcagcacaattcgcggcttgttctttggttactctcattctgatattggttttgatcgcggcggcaaaggcaatgtcgatagctataccctgggggcttatgccggttgggagcatcagaacggtgcctatgttgatggagtggtgaaagttgaccgttttgccaacaccatccatggcaagatgagtaatggggcaacagcgtttggcgattacaatagtaacggcgcgggtgctcatgtcgagagcgggttccgttgggttgacggattgtggagtgttagaccctatctggcctttaccggctttaccacagatggtcaggactacacgttatcaaacggcatgcgcgcggatgtgggaaatacccggatattacgcgctgaagcgggaacggcggtaagctatcacatggacctgcaaaacggtacgacgctggaaccctggctgaaagccgccgtgcgtcaggaatacgccgattctaaccaggtgaaagttaatgacgatggcaaatttaataatgatgtggctggaacccgtggcgtttatcaggctgggataaggtcatcgtttaccccgacgttaagcggtcatttgtcagtcagctatggcaatggcgcaggggtagaatcgccgtggaatacccaggcgggtgtggtctggacgttctga

SEQ ID NO: 412 - DNA, 1110 bp, Escherichia coli 0157:H7
atgcaaaggaaaggcaataaactgttgattcagttatgcagtgtgatactgctattttttaccacatcctggtatgcattggcgaatgaatgttatatagagagaaatgctgaaggggattatcacatgaagataagctctactcagcttagtctggcgtcacaaatggtcgaggttccgacagaaatagccgaagctacatgggatgtaaatattcaactaagaggcgatgccatagggtgtaaatctcttggggatagtaaggcagttcactttcttaatacagctgacccaagtttaatatccacgtacaccacaacgaatggcgcagcgttattaaaaacaactgttccaggcattgtgtattctgtcgagttattatgccttagttgtggtgccgcagatgaacttgatttatggctacctgcacaaagtggcgcagataacttcataccaagcacccagacgaaatgggcctatgagtacagtgatcaaagttggtatttacgttttcgcttattcataactcctgaatttaaacccaagaatggtgtttccagcggaacaacgatagcaggaaagattgcgtcatggtatataggtaccaatgaccagccgtggatcaacttttacattgacaatgactctttaaagtttttcgtcgatgaaccgacctgtgcaacagttgccctggcacaagatcagggcaacgtcagtggcaatcaggtaacgcttgggaacagctatgtttcggaagtgaaaaatgggcttacgcgggaaatccctttttctatccgtgctgaatactgttatgccagtaaaattacggttaagttgaaagcggcaaataaacccagcgatgccacactggtgggtaaaacgactggctcggcttcaggcgtggctgtaaaagtaaattcaacttatgacaatagcaaagtattgttaaaagcagatggtagcaacacggttgactacaacttcgccgcctggtcaaacaacctgctgtttttaccttttacggcgcagctggtaccggatggtagcggtaatgctgtcggtgttggaacattttcaggtaacgcgaccttctcctttacctacgaataa

SEQ ID NO: 413 - DNA, 2601 bp, Escherichia coli 0157:H7
ttgtaccagtttactcatcaaaaaagccgtatcccgaaaaaaacgctacttgcggcctgttgtgccctgttttatagcagcaacggtgctgcggcggacaccgtggaatatgacagttcctttttaatgggaactggcgcatcaacgattgatgttaaacgttatgctcaaggcaacccgacaccgccgggtctctataatgtccgcgtatttgtaaacggtcaggcgacttccagcttagaaattccgtttgtggatattggcgaaaacagtgcggcggcctgtcttacccataaaaacctggcgcaacttcacattaagcaacctgaacagcctgtcactttactcgccagagaaggtgaagaagaggattgtctggatctggcaaagtcatacgaaaaggcggatgtgtgctttgacggtagtgaccagtttctcgatctgacgatccctcaggcctatgttctgaaaagctatggcggctacgttgacccttctttatgggaatcgggaattaacgctgccacactggcatataccctgaacgcgtatcacacaagttcagataacgacaatagtgacagcgtctatggcgcgttcaactcaggtatcaatttaggagcctggcactttcgtgcgcgcggtaactataactggacaacagataacggcagcgatttcgatttccaggatcgttacttacagcgtgacattccggcaatccgttcccagataattatgggtgatgcctataccaccggtgaaacgtttgactctgtcaacgtccgtggtgttcgcctgtacagcgacagccgtatgctgccttcggcgctggccagttacgctccgaccatccgcggtgtagcaaactccaacgccaaagtcaccgtgacgcaaagcggatataaaatttatgaaaccaccgttccgcccggtgaatttgttatagacgacattagcccttccggctttggtagcgaactggtcgtgaccattgaagaagcggatggttccaaacgcacctttacgcaacccttctcgtcggttgtacaaatgcaacgtcctggtgtgggccgttgggatttcagcgcgggtaaagtcattgatgacagtctgcgatccgaacccaatatggggcaagcctcttattactatggtctgaataacctcttcacgggttataccggcattcagttcaccgataataactatcttgccgggctgttaggtgtgggtatcaacaccagcatcggcgcctttgcggtagacgttacccattcccgtgctgaaattccggatgataaaacctaccaggggcaaagttatcgcgtgacctggaacaaacttttccaggataccgggacatcatttaacctcgcggcgtaccgctattccacccaggattacctgggcctgcatgatgcgttagtcctcattgacgacgccaagcatttgtctgccgatgaagacaaaaacaccatgcagacgtactcacgtatgaaaaaccagtttaccgtcagcattaaccagccattgaatatcgcctatgaagattacggttcgctgtttatttccggtagctggacgtattactgggcggcgaacaatagccgcactgaatataatgttggttacagtaaaagcgtttcgtggggcagtttcagcgtcaacctacaacgtagctggaatgaagacggcgagaaagatgacgcgatgtacgtcagcgttagcgtacctattgagaatattttaggtggcaaacgtaagtcttctggtttccgcaatttaaatactcagctcaataccgatttcgatggttcacatcagttgaatgttaacagttccggtaacactgaaaacaatctggtgaactacagtgtcaacgcaggttatagcctcgataaaaacgccggcgatttagcctctgttggtggttatctcaactatgaatctgggttaggcggtatttccgcttcggcctcggccacttctgataacagccaacagtactccatctcaaccgatggcggctttgtattacacagtggtggtttaacgttcactaacaacagtttcagcagtaacgacacgctggtgttaatcaacgccctaggtgctaaaggcgcacgaatcaataacagtaataacgaaatcgatcgctggggatatgccgtgacgtcctctgtcagcccatatcgtgaaaaccgggtaggtctgaacattgaaacactggaaaacgatgttgaactgaaaagtaccagcgccaccaccgtaccacgtagcggctccgttgttttgacccgtttcgaaactgacgaggggcgttctgccgtgctgaatattactgccgccaatggcaaatccattccgtttgctgcggaggtttaccagggtgaggtgatgatcggcagcatgggccagggtggtcaggcatttgtacgcggtattaacgacagcggggaattaatcgtgcgctggtatgaaaacaaccaaaccattgactgtaagttgcactaccagttcccggcgcagccacaaacgcagggaagcaccaacaccttattacttaacaatcttacctgtcaggtagcaaatcactaa

SEQ ID NO: 414 - DNA, 531 bp, Escherichia coli 0157:H7
atgaagttcaaacgattgctgcatagcggcatcgccagtttgagtctggttgcctgcggggtgaatgcggcgacggatcttggcccggcaggggatattcatttctccatcactatcaccactaaagcttgcgagatggaaaaaagcgatctcgaagtcgatatgggaacaatgacgctgcaaaaacctgcggcagtcggtacggtgttgagcaagaaagatttcaccattgaactcaaagagtgcgatgggatatccaaagcgaccgttgagatggacagtcagtcggacagcgatgatgattccatgtttgcccttgaggctggtggcgcaacgggtgttgcgttgaagatagaggacgataaaggaacgcagcaagttcccaaaggctccagcggaacgccgattgaatgggcgattgatggcgaaaccacgtcgcttcactaccaggcgagttatgtggtcgtcaacactcaggccactggtggcacagcgaatgcccttgtaaatttttccatcacctatgagtaa

SEQ ID NO: 415 - DNA, 531 bp, Escherichia coli 0157:H7
atgaaatacaataacattattttcctcggtttatgtctggggttaaccacctattctgctttatccgcagatagcgttattaaaattagcgggcgcgtcctcgattatggctgcacagtctcatcggattcgcttaattttaccgtagatctccaaaaaaacagtgccagacaatttccaacgaccggtagcacaagtccagccgtcccttttcagattacgttaagtgaatgcagcaaagggacaacgggggttcgggttgcatttaacggtattgaggacgcagaaaataatactctgttgaaactggatgagggaagcaatacggcctccggtttaggtatagaaatactggacggaaatatgcgtccggtgaaactgaatgaccttcatgccgggatgcagtggatcccactggtaccagaacagaacaatattttgccttactccgctcgtctgaagtcaactcagaagtccgtcaatccgggactggtgagggcttcggcaacctttacccttgaatttcaataa

SEQ ID NO: 416 - DNA, 504 bp, Escherichia coli 0157:H7
atgaaatggcgcaaacgtgggtatttattggcggcaatattggcgctcgcaagtgcgacgatacaggcagccgatgtcaccatcacggtgaacggtaaggtcgtcgccaaaccgtgcacagtttccaccaccaatgccacggttgatctcggcgatctttattctttcagtctgatgtctgccggggcggcatcggcctggcatgatgttgcgcttgagttgactaattgtccggtgggaacgtcaagggtcactgccagcttcagcggggcagccgacagtaccggatattataaaaaccaggggaccgcgcaaaacatccagttagagctacaggatgacagtggcaacacattgaatactggcgcaaccaaaacagttcaggtggatgattcctcacaatcagcgcacttcccgttacaggtcagagcattgacggtaaatggcggagccactcagggaaccattcaggcagtgattagcatcacctatacctacagctga

SEQ ID NO: 417 - DNA, 354 bp, Escherichia coli 0157:H7
atgaaaagagcgcctcttataacaggacttttgttgatatccacatcctgcgcttatgcctcctcagaagggtgtggagctgacagcactagcggtgcgacaaattacagcagtgtggttgatgatgttacggtgaaccagacagataacgtgacaggacgggagtttacctctgcaacgctaagtagcactaactggcaatacgcctgttcctgctctgcgggtaaggcagttaaacttgtctatatggtcagccccgtacttaccaccactggacatcagacaggatattacaaactcaatgacagcctggatattaaaaccatgaaccgccccggaaatcctggagactaa

SEQ ID NO: 418 - DNA, 597 bp, Escherichia coli 0157:H7
atgaaaaaagcacttctcgcagccgctctggttatggcttctggttccgccctggctgtagatggtggtcatatcgactttaacggtatggtacagtccggtacctgtaaagtgggtgtggtagatactggtatgcatagcgttaccactgatggcgtggttaccctggatactgcgaatgttactgatacttttgctgaagttagcgcaactgctgtcggtttactgccgaaagagttcatgatttctgttgagtgtgatccaggtgctccgaagaatgctgagttaactatgggttctgcaagttacgcgaacaccagcggtaccctgaataacaatatgaacatcactgttaacggtattgcaccggctcagaacgtaaacattgcagttcataacatgaaaaacaaagctggcgctgctgaaattaagcaggtccatatgaacaactcttctgaagttcaggaactgacattagacgcagaaggtaaaggccagtacgtatttaacgcatcttacgttaaagcaccgaacagcccggctgtaactgctggtcatgtaaccactaacgcgctgtacaccgttgcttataagtaa

SEQ ID NO: 419 - DNA, 603 bp, Escherichia coli 0157:H7
atgaaaccaaatatgattgtaggagcattagcgttaacttctgtgtttatggcaggtcacctacaggcggctgatggaacagtccatttccgtggtgaaattattgacagtacttgcgaagtcactcctgaaactaaagatcaggtcgttgatttaggcaaagtaaaccgtacagcctttagtggcgtcgatgatgtggctgccccgacggctttttctatcgatctgactcaatgcccggaaacctttaagtccgccgcaattcgtttcgatggtaatgaagatgctcatggtaatggcaacctggcaattggtaccccgctggataactctaacgatgctgccgctggtattagcccgagtgataacagtggggattatactggtgcgggtgccgttagtgcagcgaaaggcgtagctattcgtttatataaccgtgcagataacactcaggtcaagttatatgaaaattctgcatcaactccgatttctaatggtaatgcatccatgaagttcatggctcgttatattgctacggaaacgactattgaccctggtacagctaacgccgactcgcagtttacagttgaatatataaaataa

SEQ ID NO: 420 - DNA, 1458 bp, Escherichia coli 0157:H7
gtgccaattttccagcgtgaaggccatctcaaatatagctttgccgcaggtgaatatcaggccgggaattatgacagcgcctcgccgcgtttcgggcagcttgatctgatctacggtttaccgtgggggatgacggcctacggcggcgtattaatctctaataattacaatgcatttacattagggatagggaaaaactttggttatatcggggcgatttccattgatgtgacgcaggctaaaagcgaactgaataacgatcgcgatagccagggacaatcttatcgtttcttatattccaagagcttcgaaagcggcaccgatttccgccttgcgggctatcggtactctaccagcggtttctataccttccaggaagccaccgatgtgcgcagtgacgctgacagcgactataaccgttatcacaagcgcagcgaaatacagggtaacctgacgcagcaattaggggcctatggctctgtttatttaaatttaacgcagcaggattactggaacgacgcaggtaaacagaacacggtatcggcgggttacaacggacgtattggcaaggtcagttacagtattgcatatagctggaataaaagccctgaatgggatgaaagcgatcgcttgtggtctttcaatatttccgttccactaggccgggcctggagtaactatcgcgtcacgaccgaccaggatggtcgtaccaatcaacaggttggggtcagcggaacgctgcttgaggatcgcaacctgagctacagtgtccaggaaggctacgccagcaacggtgtgggtaacagcggtaacgctaacgttggctatcagggtgggtccggtaatgtcaacgtaggctatagctacgggaaagattaccggcagctcaactacagcgttcgcggcggcgtgatagttcatagcgaaggcgtgacgctttcccaaccgctaggcgaaaccatgacgctcatctccgtacccggtgcgcgcaatgcccgcgtggtgaataacggcggcgttcaggttgactggatgggtaacgcgatcgtgccttatgccatgccgtatcgtgaaaacgaaatctcactgcgtagcgattcgttgggtgacgatgttgacgttgaaaatgcgttccagaaagtggtgccaacgcgtggagcgattgtcagagcgcgttttgatacccgcgttggttaccgcgtattaatgacgctgcttcgttccgcgggcagcccggtgccctttggagcaacggcaacgctaatcaccgataaacaaaacgaggtgagcagtatcgttggtgaagaaggacagctctatattagcggaatgccagaggaaggacgggtattgattaaatggggtaatgacgcgtcgcagcaatgcgtggcgccttataaattatccctggaattaaaacagggcggaattattcctgtttcggccaattgccagtaa

SEQ ID NO: 421 - DNA, 1149 bp, Escherichia coli 0157:H7
atgagtggttacaccgtcaagcctcctaccggagacagcaatgagcagacacaatttattgattattttaatctgttctacagtaagcgtgatcaggaacaaataagcatctctcagcagcttggaaattacggtgcgacatttttcagtgccagtcgccaaagttactggaacacgtcacgcagcgaccagcaaatatcatttggattaaatgtgccgtttggtgatattacgacttcgctgaattacagctattccaataatatatggcaaaacgatcgggatcatttactcgcttttacgcttaatgttcccttcagtcattggatgcgtacagacagtcagtcggcatttcgtaattcaaacgccagttacagtatgtcaaacgatttgaaaggcggcatgaccaatctatcgggggtttatggcactctgctgccggataataacctgaattatagcgttcaggtcggtaacacccacggaggtaatacatcgtctggcaccagtggttacagtactcttaattatcgtggagcttacggcaatactaatgtcggttacagtcggagtggtgacagcagccagatttattacggaatgagtggtgggattattgctcatgctgatggcatcacctttggacagccgctgggcgacacaatggttctggttaaggctcctggcgctgataatgtcaaaatagagaaccagaccggaattcataccgactggcgtggctatgccatattaccatttgcgacagaatatagagaaaatcgtgtcgctcttaacgcgaattcccttgcagataatgttgaactggatgaaaccgtggtcactgtcatcccaactcacggtgctattgccagagcaacatttaatgcacaaatcggcgggaaagtattaatgacgttgaagtacggtaataaaagcgttccattcggtgcaattgtcactcacggagagaataaaaatggcagcattgtcgcggaaaacggtcaggtttatctgactggacttccacagtcagggaaattacaggtttcatggggcaatgataaaaactcaaactgtattgtcgattacaagcttcctgaagtctctcctggaaccttgctgaaccagcagacagcaatctgtcgctaa

SEQ ID NO: 422 - DNA, 717 bp, Escherichia coli 0157:H7
atgtctgctttgtatgaacgttcacagctgacgcaggtgatgatttcatctgccccggcgactgctgaaaccatggagaaggcggaatatctgcgcctggactgcaccatcaaggaagtccagttcaccgccggtcagaaacaggatattgatgtgaccacgctctgctccacagagcaggagaacatcaacggtctgggggcgtcgtccgagatttccatgtcgggtaatttttatctgaatcaggcccagaacgccctgcgtgatgcctatgacaatgacacggtgtatgcgtttaaggtgcagtttccgtccggtaagggctttaagttcctggcggaagtgcgtcagcacacctggtcatccggtaccaacggcgtggtggctgcaacgttttcacttcgcctgaagggtaaaccggtgtcctatgtggtaccgctggcgtttgtgaaaaatctggataagacacttaccgtgaataccggtgcgctgctgacaatgtcagtcagtgtcaacgggggaacgccgccttataaacacgcctggaagaaggatggtcagccggtagagggacagactactgacactttcagtaagccaggtgcgcagtcaggtgataagggggcttatacctgcgaggtaacggattctgcagaacagccgcagagcattacctctgatgcgtgtacagtaacggttaatggtgcgggcggataa

SEQ ID NO: 423 - DNA, 531 bp, Escherichia coli 0157:H7
atgagaaacaaacctttttatcttctgtgcgcttttttgtggctggcagtgagtcacgctttggctgcggatagcacgattactatccgcggctatgtcagagataacggctgtagtgtggccgctgaatcaaccaattttactgttgatctgatggaaaacgcggcgaagcaatttaacaacattggcgcgacgactcctgtcgttccatttcgtattttgctgtcaccctgtggtaacgccgtttctgccgtaaaagttgggtttaccggcgttgcagatagccacaatgccaacctgcttgcacttgaaaatacggtgtcagcggcttcgggactgggaatacagcttctgaatgagcagcaaaatcagataccccttaatgctccatcgtccgcgatttcgtggacgaccctgacgccgggtaaaccaaatacgttgaatttttacgcccggctaatggcgacacaggtgcctgtcactgcggggcatatcaatgccacggctaccttcactcttgaatatcagtaa

SEQ ID NO: 424 - DNA, 2523 bp, Escherichia coli 0157:H7
atgaataaatccgttgtgtcaatttctgcggcaatgttggttttactttgccaaccggtcatggggagcgaaatctcacccgcaacaccgtcagatgaagacaactacacctttgacccgcaactcttccgcggcagcagatttagtcagtcgtcattagcaaaactgacaacacgtgagtctgttgcaccgggcaattataaaatggatatctacaccaacaataagttgtcaggcagttggaatgtcacgtttaaagaagccgctgatggtcgcgttctgccctgcctgacgcctgaagtcgcggacgcgataggcctcaaaacaggggaagataagggggaaaaagatcctgtctgtacgtttgctaaggaactcgctcccggcatcaccagccagacacagttgtcacaattgcgcctggacttatcggtgccacagagtcaattgattagtcgccctcgcggctatgttccccccagcgagctggataccggagcatcgctggcgttcatgaattatattgccaactattacaacgttgcctattcagggcagaatgctcatagccagcgttcgctatgggcatcatttaatggtggcatcaaccttggtgcctggcaatatcgtcagttatccaacatgacctgggataatgacaaagggaatcagtggaacaatattcgtagctatttgcaacgcccgctgcccgccataaatagccagttaatgatggggcagcttatcaccagcggaagatttttctctggactcagttatcacggcgttagtctcgcgaccgatgaacgtatgctgccggactccatgcgcggctatgcgccgactattcgcggcgtggccgcaacaaacgccagagtctcggtaatgcaaaacggtcatgaaatatatcagaccaccgtggctcctggccctttcgagataaacgacctataccccaccagctacagcggcgatctggatgtcaccgttacggaagctaacggcgcagtcagtcgtttcagtgtccccttttcagccgtaccagaatcgatgcgtccaggaacttcccgttataacgtggaagtaggtaaaacgcaggatagtggtgatgactcgatgtttggtgaccttacctggcagcacgggatgactaatacgctgacatttaacagtggttcgcgtatcgctgatggctaccaggcgctgatgctgggcggagtctatggcagttcgctgggggcatttggggcaaacctcacttggtcccatgcgcgtgttcccgaaagcgaagcgcagagtggttggatgtcgcaattaacctggagtaaaactttccagcctacttcaaccaccgtctccctggcaggttatcgatactctaccagcggctatcgtgatctggctgatgtgctgggagagcgtcatgctgccagcaataaacagtcatgggactccagccagtggcgtcaacagtcgcgcttcgatcttacgttaagtcagagccttgcgaattacggcaacctgtttgtgtcaggttcaacacagaactaccgtggcggcaagagccgtgatacacagcttcagttaggttacagcaatagctttagccatggcatcagtatgaacctttccgtcggacgccaaagaatgggcggctataaagacaattctgatgatatgcagacggtaacatccctttcattctcattcccacttggcggcaatggacctcgtgtaccaagtcttagcaacagctggacccattcaactgacggtagctcgcaattacaaagctcgctaaccggaatgcttgatgaagcacagaccaccaactacagcctgaacgtcatgcgcgatcaacaatataagcagacgacgcttagcggaaacatgcaaaaacgtttttcacaaactaccgtcggattgaacgcatcgaagggccaggattactggcaggcttcaggtaacgtacaaggcgcgatggctgtgcatggtggcggcattactttcggaccttatctgggtgaaacgttcgccctggtcgaagctaaaggcgcagaaggtgcaaaagtctataactccagtcagctggaaattaatgacagtggctatgcgcttgttccggcagtaacgccctatcgctacaaccgtatatctctcgatccacaaggaatggatggcgatgccgagttggtcgacagtgaaagacaggtagcaccggttgcgggtgcggcggtgaaagtaattttccgtacccgtcctggtaaagcgttgctgattaaatcccgcatggcagatggttcggaactgccaatgggagccgatgtgctggatgagaataatacagtcgtcggtatagccggtcagggggggcaaatttacctccgcacagaacagacaaaaggccacttgtcagttcgctggggtgaaggtgctaacgatagctgccaattgccctttgatatcagcgggaaggacagcaatagccctatcatccgcctgaatgaaacctgtcagtcttga

SEQ ID NO: 425 - DNA, 2031 bp, Escherichia coli 0157:H7
atgaaactcgccgcctgttttctgacactccttcctggcttcgccgttgccgccagctggacttctccggggttccctgcctttagcgaacagggaacgggaacatttgtcagccacgcgcagttgcccaaaggtacgcgtccactcacgctaaattttgaccagcagtgctggcagcctgcagatgcgataaaactcaatcagatgctttccctgcaaccttgtagcaacacgccgcctcaatggcgattgttcagggacggcaaatatacgctgcaaatagacacccgctccggtacgccaacattgatgatttccatccagaacgccgccgaaccggtagcaaacctggtccgtgaatgcccgaaatgggatggattaccgctcacgctggatgtcagcgccactttcccggaaggagccgccgtacgggattattacagccagcaaattgcgatagtgaagaacggtcaaataacgttacaacccgctgctaccagcaacggtttactcctgctggaacgggcagaaactgacgcctctgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattacctccagcagttgggcgttaatgctttatggataagcgccccatttgagcaaattcacggctgggtcggcggcggtacaaaaggcgatttcccgcattatgcctaccacggttattacacacaggactggacgaatcttgatgccaatatgggcaacgaagccgatctacggacgctggttgatagcgcacatcagcgcggtattcgtattctctttgatgtcgtgatgaaccacaccggctatgccacgctggcggatatgcaggagtatcagtttggcgcgttatatctttctggtgacgaagtgaaaaaaacgctgggtgaacgctggagcgactggaaacctgccgccgggcaaacctggcatagctttaacgattacattaatttcagcgacaaaacaggctgggataaatggtggggaaaaaactggatccgtaccgatatcggcgattacgacaatcctggattcgacgatctcaccatgtcgctagcctttttgccggatatcaaaaccgaatcaactaccgcttctggtctgccggtgttctataaaaacaaaacggatacccacgctaaagccatcgacggctttacccctcgcgattacttaacccactggttaagtcagtgggtccgcgactatgggattgatggttttcgggtcgataccgccaaacatgttgagttgcccgcttggcagcaactgaaaaccgaagccagcgccgcgcttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagctgtcgattgtattgcgcagatggatacgacctggcagcaaatggcggagaaattgcagggtttcaacgtgttgagctacctctcgtcgcatgatacccgtctgttccgtgaagggggcgacaaagcagcagagttattactattagcgccaggcgcggtacaaatcttttatggcgatgaatcctcgcgtccgttcggtcctacaggttctgatccgctgcaaggtacacgttcggatatgaactggcaggatgttagcggtaaatctgccgccaacgtcgcgcactggcagaaaatcagccagttccgcgcccgccatcccgcaattggcgcgggcaaacaaacgacactttcgctgaagcagggctacggctttgttcgtgagcatggcgacgataaagtgctggtcatctgggctgggcaacagtga

SEQ ID NO: 426 - DNA, 2517 bp, Escherichia coli 0157:H7
atgccacaacgacaccaccagggacataaacgcacaccgaaacagttggcgctcattatcaaacgctgtttgccgatggtgctcactggcagcggcatgctttgcactaccgctaacgccgaagagtattatttcgaccccattatgctggaaaccacaaaaagtggtatgcaaacaaccgatctgtcacgtttttcaaaaaaatacgcacaactaccaggaacttatcaggttgatatctggctgaataaaaagaaggtttcacagaaaaaaattacatttaccgccaatgcagagcaacttctgcagccacagtttacggtagaacaactacgtgagctgggtattaaggtggatgaaatcccggcgctggctgaaaaagatgacgatagcgtgatcaactcgcttgaacaaatcattcccggtacagctgctgaatttgatttcaatcatcagcgacttaatttgagcattccccaaattgcactgtaccgtgatgcaagaggttacgtctccccttctcgttgggacgatggtataccaacgctgtttaccaactactcgtttacaggttctgataaccgttaccgccagggcaatcgtagccaacgacagtacctaaatatgcaaaatggtgccaattttggcccctggcgattacgtaactattctacgtggacacgcaacgatcaggcgtcaagctggaacactatcagtagttatttacaacgtgatatcaaggcgttgaagtctcagttgcttctgggagaaagcgccaccagcggcagtattttttccagctacaactttactggcgtgcaactcgcttccgacgataatatgttgccaaacagccagcgcggatttgccccaacggtacgcggtatcgcaaacagtagtgcaatcgtgactatcaggcaaaatggttatgtgatctatcaaagcaacgtgccagcgggtgcctttgaaattaacgatctctacccctcttccaacagcggcgatttagaagtcacgattgaagaaagtgacggtacgcaacgtcgctttatccagccttattcttcattacccatgatgcagcgacctgggcatctaaaatatagcgcgaccgctggacgctatcgcgctgatgcaaacagtgatagcaaggaacccgaatttgctgaagccacggcaatatatggtttgaataatacttttacgctgtatggcggcctgctcggttctgaagattattatgcgctggggatcggtatcggcggcacacttggcgcactgggcgcgttgtcgatggatatcaacagagctgacacccaattcgataaccagcactcttttcatggctatcaatggcgtacgcagtacatcaaagatatcccggaaaccaacaccaatatcgctgtcagctactatcgctataccaacgatggctattttagttttgatgaagccaatacccgcaattgggactataacagtcgccaaaaaagtgaaattcaattcaacatcagccagacaatatttgatggggtaagtctgtatgcctccggttcacagcaagactattggggcaataacgagaaaaacaggaatatctctgttggggtttccggccagcaatggggaattggttacagcctgaattatcaatacagccgctacactgatcaaaataatgaccgcgcactctctttgaatctcagtattccgttagaacgctggttaccgcgtagccgggtttcctatcagatgaccagccagaaagatcgcccaacccaacatgaaatgcgtcttgatggctcactgctggatgatggtcgcctgagctatagtctggaacaaagtctggatgacgataacaaccataacagtagcgtgaacgccagttaccgttcaccttatggaaccttcagtgccggatacagttacggtaatgacagtagccaatacaattacggcgttaccggcggcgtggttatccatcctcatggtgtgacgctctcgcaatatctgggcaacgcttttgcgcttattgatgctaacggggcatctggcgtgaggatacaaaactatccggggattgctactgatccctttggctatgcagtggttccttatctcacaacttatcaggaaaaccgtctctcggtagatactacgcagctgcccgataacgtcgatcttgaacaaacaacacagtttgtggtgcccaacagaggtgcaatggtagcggcgcgtttcaacgccaatatcggttatcgcgtacttgttacagtcagcgatcgcaacggtaaaccgttgccctttggcgctcttgccagcaacgatgatacggggcaacaaagtatcgtcgatgagggcggcatactatatctctctgggatatcgagtaaatcacaaagctggactgtacgctggggaaatcaggcagatcaacaatgtcagtttgcttttagtacaccggattcagaaccaacaacctctgtattacaaggcacagcgcagtgccattaa

SEQ ID NO: 427 - DNA, 1035 bp, Escherichia coli 0157:H7
atgatgttcagaaatagaatattactaatatttatattgtgggctaattttacctgggctgggtgtcgtactactgcatcattaaatattacagatggtattaatgttggggagattttagcgaatgaaacttcctttagtaaaagtgtcgtgtttactgggatatcttgtgatacgagcacggataaaatagtttataaaaatatccaaagtgattgggttgaagttgggccttttggtaatggcgaaaaattaaaggttaaaatagagtctttaggtaaaaccagcgacacaattgggaaatccagcaatgcgcaggcagtattaccttatgtggttaaaatagccagaggcacacctgattttactggagaaagaaaatctacctggtttatttcagataccgtgattgcaaatattggcggtgagtcatcgtcatccatcgatttttggttgggtatttgtaaggcattgaagtttaactggtgtgtgaattatctcaccagcaaactggcgggggatacatttacgcttgggttaaatatttcctattatcctaaaaatacgacctgtaagcctgaaaacaccgttataaaagtagatgatatcgccttgttccagctcagaaatcagggaaagattgcggcgaacagtaaggaaggaacaattacgttgaaatgtgataatcttttcggcgacaaaaaacaagcatcgcggaatatggttgtatatctttctagcagtgacttagttaaaggaagtaatactattttgcgtggtaaaacagataatggtgtagggtttgtgttggatctaacagaaccaccaaaagggactgaggctgccattaaaatttcggccaacggcgatcagggcgcggcgacatcattatggaaaacagataaaccaggagtttcattaaatagcaacattattaatataccagtcatggccagttactatgtatatgatgaaaaaaaagttaaatctggcgcactggaagcaaccgcattaatcaacgtgaaatacgattaa

SEQ ID NO: 428 - DNA, 1845 bp, Escherichia coli 0157:H7
atgattaaaaaagcttcgctgctgacggcgtgttctgtcacagccttttccgcttgggcacaggataccagcccggatactctcgtcgttactgctaaccgttttgaacagccgcgcagcactgtgcttgcaccaaccaccgttgtgacgcgtcaggatatcgaccgctggcagtcgacctcggttaatgatgtgctgcgccgtcttccgggcgtcgatatcacccaaaacggcggttcaggtcagctctcatctatttttattcgcggtacaaatgccagtcatgtgttggtgttaattgatggcgtacgcctgaatctggcgggggggagtggttctgccgaccttagccagttccctattgcgcttgtccagcgtgttgaatatatccgtgggccacgctccgccgtttatggttccgatgcaataggtggggtggtgaatatcatcacgacgcgcgatgaacccggaacggaaatttcagcagggtggggaagcaatagttatcaaaactatgatgtctctacacagcaacaactgggggataagacacgagtaacgttgttgggcgattatgcccatactcatggttatgatgttgttgcctatggtaataccggaacgcaagcgcagccagataacgatggttttttaagtaaaacgctttatggcgcgctggagcataactttactgatgcctggagcggctttgtgcgcggctatggctatgataaccgtaccaattatgacgcgtattattctccgggttcaccattggtcgatacccgtaaactctatagtcaaagttgggacgccgggctgcgatataacggcgaactgattaaatcacaactcattaccagctatagccatagcaaagattacaactacgatccccattatggtcgttatgattcgtcggcgacgctcgatgagatgaagcaatacaccgtccagtgggcaaacaacatcatcattggccacggtaatgttggtgcgggtgttgactggcagaagcagagcacggcaccgggcacagcttatgttaaggatggatatgatcaacgtaataccggcatctatctgaccgggctgcaacaagtcggcgattttacctttgaaggcgcagcacgcagcgacgataactcacagtttggtcgtcatggaacctggcaaaccagcgccggttgggaattcatcgaaggttatcgcttcattgcttcctacgggacatcttataaggcaccaaatctggggcaactgtatggcttctacggaaatccgaatctggacccggagaaaagcaaacagtgggaaggcgcgtttgaaggcttaaccgctggggtgaactggcgtatttccggatatcgtaacgatgtcagtgacttgatcgattatgatgatcacaccctgaaatattacaacgaagggaaagcgcggattaagggcgtcgaggcgaccgccaattttgataccggaccactgacgcatactgtgagttatgattatgtcgatgcgcgcaatgcaattaccgacacgccgttgttacgccgtgctaaacagcaggtgaaataccagctcgactggcagttgtatgacttcgactggggtattacttatcagtatttaggcactcgctatgataaggattactcatcttatccttatcaaaccgttaaaatgggcggtgtgagcttgtgggatcttgcggttgcgtatccggtcacctctcacctgacagttcgtggtaaaatagccaacctgttcgacaaagattatgagacagtctatggctaccaaactgcaggacgggaatacaccttgtctggcagctacaccttctga

SEQ ID NO: 429 - DNA, 456 bp, Escherichia coli 0157:H7
atgaaaaacaaattgttatttatgatgttaacaatactgggtgcgcctgggattgcagccgcagcaggttatgatttagctaattcagaatataacttcgcggtaaatgaattgagtaagtcttcatttaatcaggcagccataattggtcaagctgggactaataatagtgctcagttacggcagggaggctcaaaacttttggcggttgttgcgcaagaaggtagtagcaaccgggcaaagattgaccagacaggagattataaccttgcatatattgatcaggcgggcagtgccaatgatgccagtatttcgcaaggtgcttatggtaatactgcgatgattatccagaaaggttctggtaataaagcaaatattacacagtatggtactcaaaaaacggcaattgtagtgcagagacagtcgcaaatggctattcgcgtgacacaacgttaa

SEQ ID NO: 430 - DNA, 702 bp, Escherichia coli 0157:H7
atgaacatttttgcatatttactggtacttgtattttccatgagcatgagcagcagcgcgtttgccagcgtggtaatgaccggaacccgtattattttccctggtgacgcaaaggaaaaaaccatccagttgcgaaataccagcgatcagccctatatcattaatatccatgttgaggatgaacgtggttctgacaagaatgtaccgtttatgccaaccccgcagacatttcgcatggaagctgccgcaggtcaggcgttacgcctgctctacactggtaataatttaccgcaggatcgcgagtctgttttctggtttagtttcagtcaactaccttatctgaataagaatgataaaagtcagaaccagctcatcctggccctgactaatcgagtcaaaattttctatcgtcccagctcgattgtcggtaaatccagtgacgcacccaaaaacctgacttaccaggtaaaacagaaccgcattgaagtgacgaatcccacgggctattacgtcacaattcgcgccgctgaactgcttaataatggtaaaaaagtccccctcgcgaattcggtaatgattgctcctcaaagcacaactgaatggacactaccctctggcatcagtgtcgctcccggtgcgcagatccatttagtgaccgtcaacgactatggcgtaaatgttacgtctgagcatgccttataa

SEQ ID NO: 431 - DNA, 504 bp, Escherichia coli 0157:H7
atgaaaagacttcacaagaggttcctcttagctacgttttgcgcgttattaacagcaactctccaggccgccgatgtcactatcactgttaatggtcgggtagtcgctaaaccctgcactattcaaaccaaagaagctaacgttaatctcggggatctttatacgcgcaatctgcaacaacctggttctgcatctggctggcacaatattactttgtcattaaccgattgtccggctgaaacaagtgcagtgacggcaatcgtgacaggttcaactgacaatacgggttattacaaaaatgaaggtactgccgaaaatattcagatagagcttagggatgaccaggatgcgacgttaaaaaatggcgatagcaaaacggttattgttgatgagatcactcgtaatgcacagtttccacttaaggcaagagctatcacggtgaatggaaacgcaagccagggaacgatcgaggcgctaatcaatgtgatctacacctggcaataa

SEQ ID NO: 432 - DNA, 954 bp, Escherichia coli 0157:H7
atgcgggcgaaacttctgggaatagtcctgacaacccctattgcgatcagctcttttgcttctaccgagactttatcgtttactcctgacaacataaatgcggacattagtcttggaactctgagcggaaaaacaaaagagcgtgtttatctagccgaagaaggaggccgaaaagtcagtcaactcgactggaaattcaataacgctgcaattattaaaggtgcaattaattgggatttgatgccccagatatctatcggggctgctggctggacaactctcggcagccgaggtggcaatatggtcgatcaggactggatggattccagtaaccccggaacctggacggatgaaagtagacaccctgatacacaactcaattatgccaacgaatttgatctgaatatcaaaggctggctcctcaacgaacccaattaccgcctgggactcatggccggatatcaggaaagccgttatagctttacagccagaggtggttcctatatctacagttctgaggagggattcagagatgatatcggctccttcccgaatggagaaagagcaatcggctacaaacaacgttttaaaatgccctacattggcttgactggaagttatcgttatgaagattttgagctaggtggcacatttaaatacagcggctgggtggaagcatctgataacgatgagcactatgacccaggaaaaagaatcacttatcgcagtaaagtcaaagaccaaaattactattctgtttcagtcaatgcaggttattacgtaacacctaacgcaaaagtttatgttgaaggcacatggaatcgggttacgaataaaaaaggtaatacttcactttatgatcacaatgataacacttcagactacagcaaaaatggtgcaggcatagaaaactataacttcatcactactgctggtcttaagtacaccttttaa

SEQ ID NO: 433 - DNA, 780 bp, Escherichia coli 0157:H7
ttgttttttaagcgaggaaagattttgagtgcgggacgcctgaataaaaaatctctgggtatcgtgatgttgttatcggttggactgcttttggcgggctgttcgggtagcaaatcatccgatacaggaacgtattccggctccgtttacaccgtgaaacggggggatacgctatatcgtatttcgcgcaccacgggaaccagcgtaaaagagctggcgcgactgaacggcatttcccccccttacaccattgaagttggtcagaaactaaaactgggtggggcgaaaagtagcagtagtacacgtaaatcaaccgccaaatcaacgaccaaaaccgcatcggttacaccgtcatcagcggtaccgaaatcttcctggccgccagtagggcaacgttgttggttatggccaacgacagggaaagttatcatgccgtattcgacagcagatggcggcaataaagggattgatatctcagctccacggggtacacctatttacgccgcgggtgcaggaaaggtggtgtatgtgggcaaccagctgcgtggctacggtaatctcatcatgattaaacacagtgaagattacattacggcttacgcccataatgacacgatgctggtaaataatgggcaaagcgtgaaggctgggcaaaaaatcgccaccatggggagcacggatgcggcatctgttcgcctgcatttccagattcgttaccgtgcaacggcaattgatccgctacgttacttgccgcctcagggcagcaagccaaaatgctga

SEQ ID NO: 434 - DNA, 741 bp, Escherichia coli 0157:H7
atgccaacaccaaatcctctggcaccggtgaaaggggccgggaccacactgtgggtttataacgggaacggcgacccatatgcaaacccgctttcagacaatgactggtcgcgtctggcaaaggttaaagacctgacgcccggcgaactgaccgctgagtcctatgacgacagttatctcgatgatgaagatgcggactgggccgcgaccggacaggggcagaaatccgctggagataccagcttcacgctggcgtggatgcccggagagcaggggcagcaggcgctgctggcgtggtttaatgaaggtgatacccgtgcctataaaatccgcttcccgaacggcacggtcgatgtgttccgcggctgggtcagcagtatcggtaaggcggtgacggcgaaggaagtgatcacccgcacggtgaaagtcaccaacgtgggacgtccgtcgatggcagaagatcgcagcacggtaacagcggcaaccggcatgaccgtgacgcctgccagcacctcggtggtgaaagggcagagcacgacgctgaccgtggcattccagccggaaggcgcaaccgacaagagcttccgtgcggtgtctgcggataaaacaaaagccaccgtgtcggtcagtggtatgaccatcaccgtgaaaggtgttgctgcaggcaaggtcaacattccggtcgtatccggtaatggtgagtttgctgcggttgcagaaatcaacgtcaccgccagttaa

SEQ ID NO: 435 - DNA, 717 bp, Escherichia coli 0157:H7
atgtctgctttgtatgaacgctcacagctgacgcaggtgatgatttcatctgccccggcgactgctgaaactatggataaggcggaatatctgcgcctggactgcaccatcaaggaagtgcagttcaccgccgggcagaaacaggatattgatgtgaccacgctctgctccacagagcaggagaacatcaatggtctgggggcgtcgtctgagatttccatgtcgggcaatttttatctgaatcaggcccagaacgccctgcgtgatgcctatgacaatgacgcgttgtatgcgtttaaggtgctgtttccgtccggtaagggctttaaattcctggcggaagtgcgccagcacacctggtcatccggtaccaacggcgtggtggctgcaacgttctcactgcgtctgaaaggcaaaccggtgtcctttgtggtaccgctggcgtttgtgaaaaatctggataagacacttaccgtgaataccggtgcgctgctgacaatgtcagtcagtgccaacgggggaacgccgccgtataaatacgcctggaagaaggatggtcagccggttgacgggcagacgacagacaccttcagtaagccaggtgcgcagtccgctgatgcggggaaatatacctgtgtggtgaccgattcggcagagaaagcacagagtgtgacgtctgttgaatgcaccgtgacagtgagcgcagccgccggataa

SEQ ID NO: 436 - DNA, 1056 bp, Escherichia coli 0157:H7
atgaaaaagagcactctggcattagtggtgatgggcattgtggcatctgcatccgtacaggccgcagaaatatataacaaagacggtaataaactggatgtctatggcaaagttaaagccatgcattatatgagtgataacgacagtaaagatggcgaccagagttatatccgttttggttttaaaggcgaaacacaaattaacgatcaactgactggttatggtcgttgggaagcggagtttgccggaaataaagcggagagtgatactgcacagcaaaaaacgcgtctcgcttttgccggattgaagtataaagatttgggttctttcgactatggccgtaacctgggcgcgttgtatgacgtggaagcctggaccgatatgttcccggaatttggtggcgactcctcggcgcagaccgacaactttatgaccaaacgcgccagcggtctggcgacgtatcggaacaccgacttcttcggcgttatcgatggcctgaacttaaccctgcaatatcaagggaaaaacgaaaaccgcgacgttaaaaagcaaaacggcgatggcttcggcacgtcattgacatatgactttggcggcagcgatttcgccattagtggggcctataccaactcagatcgcaccaacgagcagaacctgcaaagccgtggcacaggcaagcgtgcagaagcttgggctacaggtctgaaatacgatgccaataatatttatctggcaactttttattctgaaacacgcaaaatgacgccaataactggcggctttgccaataagacacagaactttgaagcggtcgctcaataccagtttgactttggtctgcgtccatcgctgggttatgtcttatcgaaagggaaagatattgaaggtatcggtgatgaagatctggtcaattatatcgatgtcggggctacatattatttcaacaaaaatatgtcagcgtttgttgattataaaatcaaccaactggatagcgataacaaattgaatattaataatgatgatattgtcgcggttggcatgacctatcagttttaa

SEQ ID NO: 437 - DNA, 417 bp, Escherichia coli 0157:H7
atgcgtgtcaaacatgcagtagttctactcatgcttatttcgccattaagttgggctggaaccatgactttccagttccgtaatccaaactttggtggtaacccaaataatggcgcttttttattaaatagcgctcaggcccaaaactcttataaagatccgagctataacgatgactttggtattgaaacaccctcagcgttagataactttactcaggccatccagtcacaaattttaggtgggctactgtcgaatattaataccggtaaaccgggccgcatggtgaccaacgattatattgttgatattgctaaccgcgatggtcaattgcagttgaacgtgacagatcgtaaaaccggacaaacctcgaccatccaggtttcgggtttacaaaataactcaaccgatttttaa

SEQ ID NO: 438 - DNA, 645 bp, Escherichia coli 0157:H7
atgaaaagaaaagttctggcaatgctggtcccggcgttattagttgctggcgcagcaaatgcggctgaaatttataataaagatggcaataaactggatttgtacggaaaagtagcgggcctgcactacttctctgatgatgctagcagcgatggcgacatgtcatatgcccgtatcggtttcaaaggtgaaactcagatcgctgaccaattcactggttatggtcagtgggaatttaacattggcgcaaacggtcctgaaagcgacaagggtaataccgcaacgcgtctggcatttgcaggtttcggctttggtcagaatggtactttcgactatggtcgtaactacggtgtcgtatatgacgtagaagcatggaccgatatgctgccagaatttggtggagatacctatgctggcgctgacaacttcatgaacggtcgtgctaacagcgtagcaacctatcgtaacaatggtttctttggtcaagttgatggtctgaactttgcactccagtatcagggtaacaacgagaaaagcggattatttgatcaagaaggttcaggtaacggtaatggacgtaaacttgctaaagagaacggcgacggttcagtatgtccacttcctatgactttgactttggtttaa

SEQ ID NO: 439 - DNA, 2424 bp, Escherichia coli 0157:H7
ttgaacacggtgactctggaaggaggaaccttcaataacaacggaacgcttaatgacgtcgtaaaaattgagaaaaacagcaacgcggtaattaataacaccggttccctgtcaactttacaacttcacgatggtacggtgaataacagcggtattgcgtcggcgcgcgttaacgctcagggcgatgcggtattcaataaccttgcaggcggcgaggcgcgtaaaggcgcgattctctataactctgcggtagtgaataacgcgggtacctggaaaatgggttatcaggatgaaaacaacaatgccgggacgctggatattgacgataagtcaacgttcaacaacagcggcaaactcatccttgataacagcaaaaacgccattcgcttccagggcagcaatgctaacgccacgttatataacaccggtgaaatgacgctggatgccgcattaggtgcgggcgctattctctacgacgatggcgccagcgagtttattaacaagggcgtggtggatgcgaaagtcaccgtggcggtaagtactgccggtgcgacagaaagcgatgccttcttgtggaaccaggatggcggggtaattaacttcgataaagacaacgccagcgcggttaaattcacccacaacaactatgttgctctcaacgatggtgtaatgaacatcagcggcaacaacgccgtggcgatggaaggcgataaaaacgcacagctggttaacaacggcgttatcaatctcggtaccgaaggcaccaccgataccggattgactggtatgcaactggatgccaatgccaccgccgatgcggtaattgagaacaacggcacgatcaatatttttgctaacgactcgtttgcgttcagcgtactgggcacagaaggtcatatcgttaacaacggtacggtggtgattgccgacggcgtgactggttcggggttgattaagcagggcgacagcgtgaatgtggaaggggtgaacggcaacagcggtaacaataccgaagtgcattacaccgactacacgttgccggacatgccaaacacttacaccacttcacctttcagtgaaacgactgatagcggtagtagcgatggcagcagtaacaacctcaacggctatatcgtcggtaccaacgttgacggcagcgccggtaaactgaaggtcaacaacgccagcatgaatggtgtcgggatcaacaccggtttcgccgccggtacggcagacaccacggtcagtttcgacaacgtggtggaaggcatcaacctgaccgacgccgatgccatcacctcaacgtccgtggtatggaccgccaaaggcagcaccgatgccagcggcaacgttgacgtcatcatgagcaaaaacgcctacaccgatgtggcgaccgatgcttcggtgaacgatgtggcgaaggcactggatgcgggttacaccaataacgagctgtataccagcctgaacgtgggcaccactgctgaactgaatagcgccctgaagcaggtgagcggtagccaggcgaccacggtattccgtgaagcgcgtgtgttaagcaaccgcttcagcatgctggcggatgccgcgccgaaggtgggcaatggcctggcctttaacgtggtggcgaaaggtgacccgcgtgcggaactcggaaataacaccgagtatgacatgctggcactgcgtaaaaccgttgacctgagcgaaagccagagcatgagcctggaatacggtatcgcgcgtctggatggcgacggtgcgcagaaagcgggcgacaatggcgtaaccggcggctacagccagttctttggcctgaagcaccagatgtccttcgacaatggtatgcgttggaacaacgcgctgcgttatgacgtgcataatctcgacagcagccgctcggtcgcttacggcgacgtcagcaaaacggcggatacggatgtgaaacagcagtacctggagttgcgtagcgaaggggcgaaaacctttgagccgcgcgaagggctgaaaatcaccccgtacgccggagtgaaactgcgtcactcgctggaaggcggctatcaggagcgcaatgccggagactttaacctgagcatgaacagcggcagcgaaacggcggtggacagcatcgtcgggctgaaactggactacgcagggaaaggcggctggagcgcgaatgcgacgctggaaggcgggccgaacctgagctacagcaagagccagcgcacggcaagccttgcaggggcaggcagccagcactttaacgtcgatgacggtcagaagggcggcggtatcaacagcctggcgagcgtcggcgtgaagtacagtagcaaagaaagttcgctgaatctggatgcgtatcactggaaagaggacggcatcagcgacaaaggcgtgatgctgaactttaagaaaacgttctaa

SEQ ID NO: 440 - DNA, 747 bp, Escherichia coli 0157:H7
atgcttaatggaattagtaacgctgcttctacactagggcggcagcttgtaggtatcgcaagtcgagtgagctctgcggggggaactggattttctgtagcccctcaggccgtgcgtcttactccggtgaaagttcattcccctttttctccaggctcgtcgaatgttaatgcgagaacgatttttaatgtgagcagccaggtgacttcatttactccctctcgtccggcaccgccgccaccgacaagtggacaggcatccggggcatcccgacctttaccgcccattgcacaggcattaaaagagcacttggctgcctatgaaaaatcgaaaggtcctgaggctttaggttttaagcccgcccgtcaggcaccgccgccaccgacaagtggacaggcatccggggcatcccgacctttaccgcccattgcacaggcattaaaagagcacttggctgcctatgaaaaatcgaaaggtcctgaggctttaggttttaagcccgcccgtcaggcaccgccgccaccgacaagtggacaggcatccggggcatcccgacctttaccgcccattgcacaggcattaaaagagcacttggctgcctatgaaaaatcgaaaggtcctgaggctttaggttttaagcccgcccgtcaggcaccaccgccaccgacagggcctagtggactaccgccccttgcacaggcattaaaagatcatttagctgcctatgagcaatcgaagaaagggtaa

SEQ ID NO: 441 - DNA, 2241 bp, Escherichia coli 0157:H7
atgaacaagaagattcattccctggccttgttggtcaatctggggatttatggggtagcgcaggcacaagagccgaccgatactcctgtttcacatgacgatactattgtcgttaccgccgccgagcagaacttacaggcgcctggcgtttcgaccatcaccgcagatgaaatccgcaaaaaccccgttgcccgcgatgtttcggagatcatccgtaccatgccaggcgttaacctgaccggtaactccaccagtggtcagcgagggaataaccgacagattgatattcgcggtatgggtccggaaaacacgctgattttgattgacggcaagccggtaagcagccgtaactcggtgcgtcagggctggcgtggcgagcgcgatacccgtggtgatacctcctgggtgccacctgaaatgattgaacgtattgaagttctgcgtggtccggcagctgcgcgttatggcaacggcgcggcgggcggcgtggttaacatcattaccaaaaaaggcagcggcgagtggcacggctcctgggacgcatatttcaatgcgccagaacataaagaggaaggtgccaccaaacgcactaactttagcctgaccggtccgctgggcgacgaattcagcttccgcttgtatggcaacctcgacaaaacccaggctgacgcgtgggatatcaaccagggtcatcagtccgcgcgtgccggaacgtatgccacgacgttaccagccgggcgcgaaggggtgatcaataaagatattaatggcgtggtgcgctgggacttcgcaccattgcaatcgctggaactggaagcgggttacagccgccagggtaacctgtatgcgggcgatacccagaacaccaactctgacgcttacactcgctcgaaatatggcgatgaaaccaaccgcctgtatcgccagaactactcgctgacctggaacggtggctgggataacggcgtgaccaccagcaactgggtgcagtacgaacacacccgtaactcgcgtattccggaaggtctggcgggcggtaccgaagggaaatttaacgaaaaagcgacacaggatttcgtcgataacgatcttgatgacgtgatgctgcatagcgaagttaacctgccgattgatttcctcgttaaccagacgctgacgctgggtacggagtggaatcagcagcggatgaaggacttaagttccaacacccaggcactgaccggaacgaataccggtggcgctattgatggcgtgagtgccaccgaccgtagcccgtattcaaaagcagaaattttctcgctgtttgccgaaaacaacatggagctgactgacagcaccatcgtaacgccggggctgcgtttcgatcatcacagtattgtcggcaataactggagcccggcgctgaacatatcgcaaggtttaggcgatgacttcacgctgaaaatgggcattgcccgcgcctataaagcgccgagcctgtaccagactaacccgaactacattctctacagtaaaggtcagggctgctatgccagcgcgggcggctgctatctgcaaggtaacgatgacctgaaagcagaaaccagcatcaacaaagagattggtctggagttcaaacgcgacggctggctggcgggcatcacctggttccgtaacgattatcgcaataagattgaagcaggctatgttgctgtagggcaaaacgcagtcggcaccgatctctatcagtgggataacgtgccgaaagcggtggttgaaggtctggaaggatcgttaaacgtaccggttagcgaaacggtgatgtggactaataacatcacttatatgctgaagagtgaaaacaaaaccacgggcgaccgtttgtcgatcatcccggagtatacgttgaactcaacgctgagctggcaggcacgagaagatttgtcgatgcaaacgaccttcacctggtacggtaagcagcagccgaagaagtacaactataaaggtcagccagcggttggaccggaaaccaaagaaattagtccttacagcattgttgggctgagcgcgacgtgggatgtgacgaagaatgtcagtctgaccggcggcgtggacaatctgttcgacaaacgtttgtggcgtgcgggtaatgcccagaccacgggcgatttggcaggggccaactatatcgccggtgccggggcgtatacctataacgagccgggacgtacgtggtatatgagcgtaaacactcacttctga

SEQ ID NO: 442 - DNA, 396 bp, Escherichia coli 0157:H7
ttgggagggcgatttagtctcaggtacaaaaaactctcatatagattcgtttttctgaccttggcaggttgttcttcagtaggcaaccagtcattgaaaaatgagacgcaggaaagtgtgaaaaccaaaattgttaaaggcaaaactacaaaacaggacgtgttagcatcgttcggtgaacctgacagccgttctttgatcgatggtgaagaacaatggtcatacactatgtataacagccagtccaaagcaacctctttcatccccgttgtgggactgcttgcaggtggcgcagactcacaaactaaatctctgacagtttctttcaaaggcgaaaaagtcagcacatacatctttaatgctggaacaagcaacgtgaagactggcattttttag

SEQ ID NO: 443 - DNA, 516 bp, Escherichia coli 0157:H7
atgaaaaaaattgcatgtctttcagcactggccgcagttctggctttcaccgcaggtacttccgtagctgcgacttctaccgtaactggcggttacgcacagagcgacgctcagggccaaatgaacaaaatgggcggtttcaacctgaaataccgctatgaagaagacaacagcccgctgggtgtgatcggttcattcacttacaccgagaaaagccgtactgcaagctctggtgactacaacaaaaaccagtactacggcatcactgctggtccggcttaccgcattaacgactgggcaagcatctacggtgtagtgggtgtgggttatggtaaattccagaccactgaatacccgacctacaaacacgacaccagcgactacggtttctcctacggtgctggtctgcagttcaacccgatggaaaacgttgctctggacttctcttacgagcagagccgtattcgtagcgttgacgtaggcacctggattgccggtgttggttaccgcttctaa

SEQ ID NO: 444 - DNA, 735 bp, Escherichia coli 0157:H7
atgaagagtatagcaacactggttgtgtgtgcaatctccgggattgcctgtgtaaatttatctgcacatgcagcagaaggagagcatacaatttctctggggtatgcgcactttcagtttccgggactgaaggattttgtaaaggatgcgactgctcataacagggagactttcagtcatttcgtcaacagaaactacttttcttcattgggcgaatatacagatggtcgggtcagtggatatgaaggcaaggataaaaatccacagggcattaatatcaggtatcgctacgagataacggatgattttggcgttatcacctcttttacatggacgcgttctctcactaactcacagacatttattgatgtgcagtcagccgatcataccaggaagattaagaatccggcagcttctgccagaacggatatcagggcgaattactggagtctgttagcggggccttcatggcgggttaatcagtacatgagtttatatgcgatggcagggatgggcgttgctaaagttagcgctgacctgaaaattaaggacaatattaacagtagtggcggattttctgaaagcaacagcacgaaaaaaacctcccttgcgtgggctgcaggtgcacagtttaacctgaatgagagtgttacactggatgtggcttacgaaggttccggctctggcgactggcgcacgagtggcgttactgctggcattggcctgaaattctga

SEQ ID NO: 445 - DNA, 600 bp, Escherichia coli 0157:H7
atgcgtaaactttatgccgccattttgtccgcagccatttgtctgaccgtatccggtgcgcctgcatgggcgtctgagcagcaggccacgctgagcgcggggtatcttcatgtctcgacgaacgctcccggtagcgataatcttaacgggattaacgtgaaataccgttatgaattcacggacacgctggggctggtgacgtcattcagctatgcaggagacaggaatcgccagattacccgttacagcgatacccgctggcatgaagattccgtgcgtaaccgctggttcagcgtaatggcggggccgtctgtgcgcgtgaatgaatggttcagcgcgtatgcgatggcgggagtggcttacagccgtgtgtcgactttctccggggattatctccgcgtaactgacaacaaggggaaaacgcacgatgtgctgaccggaagtgatgacggtcgccacagcaacacgtctctggcgtggggggctggcgtgcagtttaacccgaccgaatccgtggccattgatattgcttatgaaggctccggcagtggcgactggcgcactgacggtttcatcgtgggtgtcggttataagttctga

SEQ ID NO: 446 - DNA, 600 bp, Escherichia coli 0157:H7
atgcgtaaactttatgccgccattttgtccgcagccatctgtctggccgtatccggcgcgcctgcatgggcgtctgagcagcaggccacgctgagcgcggggtatcttcatgcccggacgagcgctcccggtagcgataatcttaacgggattaacgtgaaataccgttatgaatttacggacacgctggggctggtgacgtcattcagctatgcaggagacaagaatcgccagcttacccgttacagcgatacccgctggcatgaagattccgtgcgtaaccgctggttcagcgtaatggcggggccgtctgtgcgcgtgaatgaatggttcagcgcgtatgcgatggcgggtgtggcttacagccgtgtgtcgactttctccggggattatcttcgcgtaactgacaacaaggggaaaacgcacgatgtgctgaccggaagtgatgacggtcgccacagcaacacgtctctggcgtggggggctggcgtgcagtttaacccgaccgaatccgtggccattgatattgcttatgaaggctccggcagtggcgactggcgcactgacggtttcatcgtgggtgtcggttataagttctga

SEQ ID NO: 447 - DNA, 600 bp, Escherichia coli 0157:H7; identical to SEQ ID NO: 446

SEQ ID NO: 448 - DNA, 600 bp, Escherichia coli 0157:H7
atgcgtaaactttatgccgccattttgtccgcagccatctgtctggccgtatccggcgcgcctgcatgggcgtctgagcagcaggccacgctgagcgcggggtatcttcatgcccggacgagcgctcccggtagcgataatcttaacgggattaacgtgaaataccgttatgaatttacggacacgctggggctggtgacgtcattcagctatgcaggagacaagaatcgccagcttacccgttacagcgatacccgctggcatgaagattccgttcgtaaccgctggttcagcgtaatggcggggccgtctgtgcgcgtgaatgaatggttcagcgcgtatgcgatggcgggtgtggcttacagccgtgtgtcgactttctccggggattatcttcgcgtaactgacaacaaggggaaaacgcacgatgtgctgaccggaagtgatgacggtcgccacagcaacacgtctctggcgtggggggctggcgtgcagtttaacccgaccgaatccgtggccattgatattgcttatgaaggctccggcagtggcgactggcgcactgacggtttcatcgtgggtgtcggttataagttctga

SEQ ID NO: 449 - DNA, 1347 bp, Escherichia coli 0157:H7
atggtcatgagccagaaaaccctgtttacaaagtctgctctcgcagtcgcagtggcacttatctccacccaggcctggtcggcaggctttcagttaaacgaattttcttcctctggcctgggccgggcttattcaggggaaggcgcaattgccgatgatgcaggtaacgtcagccgtaaccccgcattgattaccatgtttgaccgcccgacattttctgcgggtgcggtttatattgacccggatgtaaatatcagcggaacgtctccatctggtcgtagcctgaaagccgataacatcgcgcctacggcatgggttccgaacatgcactttgttgcaccgattaacgaccaatttggttggggcgcttctattacctctaactatggcctggcaacagagtttaacgatacttatgcaggcggctctgtcgggggtacaaccgaccttgaaaccatgaacctgaacttaagcggtgcgtatcgcttaaataatgcatggagctttggtcttggtttcaacgccgtctacgctcgcgcgaaaattgaacgtttcgcaggcgatctggggcagctggttgctggtcagattatgcaatctcctgccgggaagactcctcaagggcaagcattggcagctaccgccaacggtatcgacagtaataccaaaatcgctcatctgaacggcaaccagtggggctttggatggaacgccggtatcctgtatgaactggataaaaataaccgctatgcactgacctaccgttctgaagtgaaaattgacttcaaaggtaactacagcagcgatcttaatcgtgtgtttaataactacggtttgccaattcctaccgccacaggtggcgcaacgcaatcgggttatctgacgctgaacctgcctgaaatgtgggaagtgtcgggttataaccgtgttgatccgcagtgggcgattcactatagcctggcttacaccagctggagtcagttccagcagctgaaagcgacctcaaccagtggcgacacgctgttccagaaacatgaaggctttaaagatgcttaccgcatcgcgttgggtaccacttattactacgatgataactggaccttccgtaccggtatcgcctttgatgacagcccagttccggcacagaatcgttctatctccattccggaccaggaccgtttctggctgagtgcaggtacgacttacgcgtttaataaagatgcttcagtcgacgttggtgtttcttatatgcacggtcagagcgtgaaaattaacgaaggcccataccagttcgagtctgaaggtaaagcctggctgttcggtactaactttaactacgcgttctga

SEQ ID NO: 450 - DNA, 1206 bp, Escherichia coli 0157:H7
atggccttttctcaagcggttagcggattaaacgctgccgccaccaacctcgatgttattggcaacaatatcgccaactccgccacctacggctttaaatcaggcacggcctcttttgccgatatgtttgccggttcgaaagtgggactgggggtaaaagttgccggtatcactcaggactttaccgatggcacgaccaccaacaccgggcgtggtctggacgttgctatcagccagaacggttttttccgtctggtagatagcaacggttcggtgttctacagccgtaacggacaatttaagctggatgaaaatcgtaacctggtgaatatgcaaggtttacagctgacgggttacccggcaaccggtacgccgccgactattcagcaaggggcgaatccgactaacatttcgatcccgaataccctgatggcagcgaaaactaccaccacggcgtcgatgcagatcaacctgaattccagcgatccgcttccctctgttaacgcatttgatgccagcaatgcggatagctataacaaaaaaggttcggtgactgttttcgacagtcagggtaatgctcatgacatgagcgtctactttgtgaagaccggggataataactggcaggtctacacccaggatagcagtgatccaacaggtacagccgagcctgcaatgaagctggtgtttaatgccaatggcgttctgacctcaaatccaacagagaatattaccaccggcgcaattaacggcgcagaacccgccacgtttagcctgagcttcctcaactccatgcagcaaaataccggcgctaacaacattgtggcaaccacccagaatggctacaaaccgggcgatctggtgagttatcaaatcaatgatgacggtacggttgtcggcaactattccaacgaacaaacccaactgctggggcagattgtactggcgaactttgccaacaacgaaggtctggcatccgaaggcgacaacgtctggtctgcgacgcaatcttctggcgtggcgctgttggggacagccgggacgggcaactttggcaccctgaccaacggtgcgttggaagcgtccaacgtcgatctcagtaaagaactggtcaatatgatcgttgcccagcgtaactatcagtctaacgcccagaccatcaaaacccaggaccagatcctcaacacgctggttaacttacgctaa

SEQ ID NO: 451 - DNA, 1335 bp, Escherichia coli 0157:H7
atgtctaaatcgacttttttacacattctgattagctccatcatattggtggcactaatacaatcatccgcttgggctaactgtacaaacacacagataggtcaaactgaagatggtcggacagcgcttattgagttcggaaaaattaatatgaccgacacctattttgcgccagcaggttcactcctcgcgacaacggtcgtacctcccactaactacacatcaggtggcgcgacaggaagctccgtattgtgggaatgtgatgcaacagatttgccaaacatctattttctggtcgctaccaatggcgacgaccgcgtggggggcttttacgatgcaggcgggcctgatggtctgagtgatgtctatgccacctggttcgcttttgtcggtctcaagcagaccatggcgggcgtgacgcttggtcgttactggaagaaagtgcccatcaccagttatgccactcagggaactaaaatccagattcgcttacaggatatccctcctcttcatgctgagctttatcgcatcagtacgctacctgatacatcagcaacaacaagttggtgcggtaataataatacagatagtagtggagtcggattcgcaaaaccttccggtacaatctataactgtgttcagcccaatgcctatattcagctttccggtaccagcggcattttatttggtcatgatgagcccggcgaagatagttctgttcattgggatttctggggtgctgataatggttttggttacggaatgcgttcggccaatcgactctacaacaatgccacctgcgttgcccgcagcgccacgccgttagtattgctgccgacaattgcagaagcacaactgaatgcgggcatggaaagtaccggtaattttaatgtccgcgtcgagtgtagtaactcggttcaatcagggattagcgatactcagacagcattaggaatccaggtgtctgaaggtgcatatacagcggcgcaaaaactggggattatcaatagcaacggcggcgtcagcgccctggtctctgataattatgacgcagcagagatggcaaagggcgttgggatctacatttctaacagtgctcaccccgatacggcgatgacgctggttggtcaaccgggcatcgcgaagttaacccccggaggaaatgcagcggggtggtatcctgtatttgaaggggcaacattagaaggtgcgactcaccccggatactccagctatagttactcttttatcgcccggttgaagaaactgccaaatcagacagtcagtgcgggaaaagtgcgggcaacggcttatatattggtgaaaatgcaatga

SEQ ID NO: 452 - DNA, 2283 bp, Escherichia coli 0157:H7
atggaaaacaatcgcaatttccctgccagacaatttcattcgctcacgttctttgccggtctttgtattggcatcacgcctgtggctcaggcactcgccgccgaagggcaaactaacgcggatgacacgctggttgtcgaagcatcaacgccttcgctttatgcgccacaacaatctgccgatccgaaattctcgcgtccggtagcggatactacccgcacgatgacggtgatttctgaacaagtgattaaagatcagggcgcaaccaaccttaccgatgcgctcaaaaacgtccccggcgtgggtgcgttttttgcgggtgagaacggtaactccaccactggcgacgccatttatatgcgcggtgctgatacctctaacagtatttatattgatggcattcgcgatatcggcagcgtctcgcgcgacaccttcaatactgagcaggtcgaagtgattaaagggccttccggcaccgactacgggcgcagcgcgccgacgggctcgatcaatatgatcagcaagcagccgcgcaatgattccggcattgacgcctccgccagtattggcagcgcctggttccgccgcggcacgctggacgtcaatcaggtcattggtgataccactgcggtgcgcctgaatgtgatgggcgaaaaaacgcacgatgccggacgcgacaaagtcaaaaatgagcgttacggcgtcgccccttctatcgcttttggccttggtacagcgaatcgtttgtatcttaattatctgcatgtcacccagcacaacacgccagacggcggcattccaaccatcggtttgccgggctattctgccccatctgcaggaacggcgaccctgaatcattccggaaaagttgatacgcataacttttacggcacggattccgattacgacgattcgaccaccgacaccgccaccatgcgttttgagcacgatatcaacgataacaccaccattcgcaacactacccgttggtcgcgcgtgaagcaggattacctgatgacggcgattatgggtggggcgtcgaatattacccagcccaccagcgatgtgaatagctggacgtggtcacgcacggcgaataccaaagatgtgagtaataaaattctcaccaaccagaccaacctgacctcgacattctataccgcttctatcggtcatgatgtcagtaccggcgtggaatttacccgtgaaacgcagactaactacggcgttaatccggtgacgttacctgcggtaaatatttatcatcctgacagcagcattcatcccggcggcctgacgcgcaacggcgcaaacgccaatggtcagacggataccttcgcaatttacgcattcgatacgctgcaaatcacccgtgattttgagctgaacggcgggatccgtctggataattatcatactgaatatgacagtgccaccgcctgcggcggcagcggacgcggtgccatcacctgcccagctggtgtggcaaaaggttctccggtcaccaccgtcgacaccgccaagtcgggcaatctggtgaactggaaagccggggcgctgtatcacctgacggaaaacggcaatgtctatattaactatgccgtttcccagcagcctccgggcggcaacaacttcgcccttgcgcagtctggcagcggtaacagtgccaaccgcaccgattttaaaccgcaaaaagccaacaccagcgagattggcaccaaatggcaggttctggataaacgcctgttgctcaccgccgcgctgttccgtactgatatcgaaaatgaagttgagcaaaatgatgacgggacttactcgcaatacggtaagaaacgcgtcgaaggctatgagatatccgtggcagggaatatcactcccgcgtggcaggtgattggcggctatacccagcaaaaagcaaccatcaaaaacggcaaagatgttgcccaggatggttcctcatcgctgccgtataccccggagcacgccttcaccttatggagccaatatcaggcaaccgatgatatctctgttggcgcgggcgcacgctatatcggcagtatgcataaaggttcagacggcgcggtgggaacgccagcgtttaccgaaggttactgggtcgccgatgccaaactggggtatagggttaatcgcaatctcgacttccagctaaacgtctacaacctgtttgataccgattacgtcgcctcaatcaataagagcggctaccgttatcacccgggcgagccaagaaccttcttgctcacagccaatatgcatttctga

SEQ ID NO: 453 - DNA, 1488 bp, Escherichia coli 0157:H7
atgcaaatgaagaaattgctccccattcttatcggcctgagcctttctgggttcagttcgttgagccaggccgagaacctgatgcaagtttatcagcaagcacgccttagtaacccggaattgcgtaagtctgccgccgatcgtgatgctgcctttgaaaaaattaatgaagcgcgcagtccattactgccacagctaggtttaggtgcagattacacctatagcaacggctaccgcgacgcgaacggcatcaactctaacgcgaccagtgcgtccctgcagttaactcaatccatttttgatatgtcgaaatggcgtgcgttaacgctgcaggaaaaagcagcagggattcaggacgtcacgtatcagaccgatcagcaaaccttgatcctcaacaccgcgaccgcttatttcaacgtgttgaatgctattgacgttctttcctatacacaggcgcaaaaagaagcgatctaccgtcaattagatcaaaccacccaacgttttaacgtgggcctggtagcgatcaccgacgtgcagaacgcccgcgcgcagtacgataccgtgctggcgaacgaagtgaccgcacgtaataaccttgataacgcggtagagcagctgcgccagatcaccggtaactactatccggaactggcggcgctgaatgtcgaaaactttaaaaccgacaaaccacagccggttaacgcgctgctgaaagaagccgaaaaacgcaacctgtcgctgttacaggcacgcttgagccaggacctggcgcgcgagcaaattcgccaggcgcaggatggtcacttaccgactctggatttaacggcttctagcgggatttctgacacctcttatagcggttcgaaaacccgtggtgccgctggtacccagtatgacgatagcaatatgggccagaacaaagttggcctgagcttctcgctgccgatttatcagggcggaatggttaactcgcaggtgaaacaggcacagtacaactttgttggtgccagcgagcaactggaaagcgcgcatcgtagcgtcgtgcagaccgtacgttcctctttcaacaacattaatgcttctatcagtagtattaacgcctacaaacaagccgtagtttccgctcaaagctcattagacgcgatggaagcgggctactcggtcggtacgcgtaccattgttgatgtgttggatgcgaccaccacgctgtacaacgccaagcaagagctggcgaatgcgcgttataactacctgattaatcagctgaatattaagtcagccctgggtacgttgaacgagcaggatctgctggcactgaacaatgcgctgagcaaaccggtttccactaatccggaaaacgttgccccgcaaacgccggaacagaatgctattgctgatggttatgcgcctgatagcccggcacccgtcgttcagcaaacatccgcacgcactaccaccagtaacggtcataaccctttccgtaactga

SEQ ID NO: 454 - DNA, 747 bp, Escherichia coli 0157:H7
gtgaccaaactcaaacttctggcacttggagtgcttatcgcaacgtctgcaggcgtagcgcacgctgaaggtaaattttccctgggcgcaggcgtaggtgtcgttgaacacccatataaagattacgataccgatgtttacccagtaccggtaatcaactatgaaggcgataacttctggttccgtggcttaggtggtggttactacctgtggaatgacgcaacggataaactttcaattaccgcttactggtcgccgctttacttcaaagctaaagacagtggcgatcaccaaatgcgtcacctggatgaccgtaagagcaccatgatggctggtctgtcttatgctcactttacccagtacggttacctgcgtaccaccctggctggcgataccctggataacagcaacggcatcgtctgggatatggcctggttgtatcgttacaccaacggtggcctgaccgtgactccgggtattggtgtgcagtggaacagcgaaaaccagaacgaatactattatggcgtatcgcgcaaagagtccgctcgcagcggtctgcgtggctataactcgaacgacagctggagcccttacctggagctgagcgccagctacaacttcctcggcgactggagtgtttacggtaccgcgcgctacacccgtctgtctgatgaagttactgacagcccgattgtggataaatcctggactggcctgatttctaccgggatcacctacaaattctga

SEQ ID NO: 455 - DNA, 885 bp, Escherichia coli 0157:H7
atgaaaaaaacattactggcagccggtgcggtactggcgctctcttcgtcttttactgtcaacgcagctgaaaacgacaaaccgcagtatctttccgactggtggcaccagagcgttaacgttgtcggaagctatcacacccgtttcggaccgcagatccgcaacgatacctaccttgagtacgaagcattcgctaaaaaagactggttcgacttctatggttatgcggatgcgccggtattcttcggcggtaactccgatgcaaaaggtatctggaaccacggttctcctctgtttatggaaatcgaaccacgtttctccatcgacaagctgaccaatactgaccttagcttcggtccgttcaaagagtggtacttcgcgaacaactacatttacgacatgggtcgtaataaagatggtcgccagagcacctggtacatgggtctgggtaccgatatcgacactggcctgccgatgagcctgtccatgaacgtctatgcgaaataccagtggcagaactatggcgcagcgaacgaaaacgagtgggacggttaccgtttcaaaattaaatactttgtgccgattaccgatctgtggggcggtcagctgagctacatcggcttcaccaacttcgactggggttccgatttaggggatgacagcggtaacgcaatcaacggtattaagacccgtactaataactctatcgcttccagccatattctggctctgaactacgatcactggcactactctgtcgtagctcgttactggcacgacggtggtcagtggaacgacgatgcagaactgaacttcggcaacggcaacttcaacgttcgctctaccggctggggtggttacctggtagtaggttacaacttctga

SEQ ID NO: 456 - DNA, 2190 bp, Escherichia coli 0157:H7
atgctttcaacacaatttaacagggataatcaatatcaagccatcaccaaaccgtcactacttgccggttgcatagcactggcactattaccttctgccgcttttgctgcaccagccactgaagaaacggtgattgttgagggttcagccacagctccagatgatggcgaaaatgattacagcgtaacgtctacctctgcgggtaccaaaatgcagatgactcaacgtgatattcctcagtcggtcactattgttagccagcagcggatggaagatcagcagttacaaacgctgggcgaagtgatggaaaacacgctggggatcagcaaaagtcaggcggattccgatcgtgctctttattattcccgcggattccagatcgataactatatggttgatggtatccccacctattttgaatcgcgctggaatctgggcgacgcactttctgatatggcactgtttgaacgcgtagaagtagtgcgtggcgcgacaggactcatgaccgggacgggtaatccatctgcggcaattaatatggttcgaaaacacgcgaccagtcgtgaatttaaaggcgatgtctcggcggaatacggtagctggaacaaagaacggtatgtggcggatttacaaagcccactcaccgaagacggtaaaatccgcgcgcgaattgtcggcggctaccagaataacgactcatggctggaccgctacaatagtgaaaagaccttcttctccggcattgtcgatgctgatttaggcgatcttacgacgctttcagccggttacgaatatcagcgcattgatgttaatagcccaacctggggcggtttaccgcgctggaatactgatggcagcagcaacagttacgatcgcgcacgcagtaccgcacctgactgggcgtacaacgataaagagatcaacaaggtctttatgaccctgaagcagcggtttgctgatacctggcaagcgacactgaatgccacccactctgaagtcgaatttgacagcaaaatgatgtatgtcgatgcctatgtaaacaaagcggatggtatgctggttgggccatacagtaattatggacctggctttgattatgtcggcggcaccggttggaacagtggcaaacgtaaagttgatgcgctggatttgttcgctgacggtagttatgaattgtttggtcgtcagcacaatctaatgtttggtggcagttacagcaaacaaaacaatcgttacttcagttcatgggccaacatcttcccggatgaaattggcagtttctacaactttaatggcaatttcccacaaaccgactggtcaccacagagcctggcgcaggacgataccacacatatgaaatcgttatatgctgccactcgtgtcacccttgccgatccgctgcatctgatcctcggcgcacgttataccaactggcgggttgatacgctgacttacagcatggagaaaaaccacaccacgccttacgctggtctggtgtttgacatcaatgacaactggtcgacctacgccagctatacctctattttccagccgcaaaatgatcgtgacagttcaggcaaatatctggctccaatcaccggtaacaactacgagctgggtctgaaatcggactggatgaatagccgtctgaccaccacgttagccatcttccgtattgagcaggataatgtcgctcagtccaccggtacacctatccccggcagcaacggcgaaaccgcctataaagcggtggatgggacagtcagtaaaggggtggaatttgaactcaacggcgcaattaccgacaactggcagctgacatttggcgcaacgcgctatattgcagaggataacgaaggaaacgccgttaatcctaatctgccacgcaccacggttaaaatgttcaccagctatcggttgcctgtcatgccagagttgacagtcggcggtggtgttaactggcaaaatcgcgtgtataccgacaccgtgacaccgtatggcaccttccgcgccgagcaaggtagctacgcgttggtggatctcttcacccgctaccaggtgacgaaaaacttctcgttacaggggaacgtcaataacctgttcgacaaaacctacgataccaacgtggaaggttctatcgtctacggcgcaccgcgtaatttcagcattaccggcacgtatcaattctga

SEQ ID NO: 457 - DNA, 1356 bp, Escherichia coli 0157:H7
atggcgcgattccagtttaaaaaccgtaaaaataatggacttattttttttataagttttatggtgatgggagaagctgcaattgctgcaccgctgccacaatgggcgaatgccccagcggtaacgccagttgcccaattatctttacaggaaagtatattacgcgcctttgcgcgaaatcccggtgtcactcaacaggcggcgcagataggtattggcgaagcgcaaattgatgaagccaaaagtgcctggtatccgcacgttggattaaccggcaacgcggggccgtcccgacaaacggactccagcggcaggcttgataacaacgtttcgtatggcataaccctgacacaactggtgtatgactttggtaaaactaacaacgatatcaatctgcaaactgccgcccgtgacagctaccgctttaaattgatggcaaccttaaccgatgttgcagagaaaacggcgactgcctacatggaagtcagtcgttatcaggctttgtgcgatgcggctcaacgcaatattcactcgctggaaaacgtctacaacatggcggcattgcgcgctaacgcaggcctgaactcatcgtcggatgaattacaggcccagacgcgtattgccggaatgcgctcaacgctggagcaatatcaggcgcagatggcgagcgccaaagcgcaactggcggtgctcactggcgtacagccggaggcgatagccgcgccacctgctgaattagccgagcagccggtatcgctgaagaatattgattaccagtccatcccgctggtgctggcggcagaaaacttacgccagtcagcacagtacggcgtggaaaaaacgaaagcgcaatactggccaacgctcagtattcaggggggtaaaacgcgctaccagaccagcgaccgctcgtattgggatgatcagctacaactgaacgttaacgcgccgctgtatcagggcggcgcggtttctgcccaggtgcaacaggccgaagggcaacaaaaaatctctgcctcgcaggtcgaacaggcaaaactggatgtgctgcaacgagcgtctgtggcatatgcgaactggaccggcgcacggggtcgtgaagaagccggtttagcgcaatccgaaagtgcgcacaaaacgcgagatgtgtaccaaaatgaatataaattgggtaaacgcagtctgaatgatctattaaccgtcgaacaagatgtctttcaggcgcaatcggctgaaataaatgccaattatgatggctgggtcgccgccgtaaattatgccgctgcggtgaataaccttattccattagcgggaattaaacagggcttatacaacgacttacccgacttgaaataa

SEQ ID NO: 458 - DNA, 2142 bp, Escherichia coli 0157:H7
atggctaagttcacaccttcattctcaggaatcaaaggtcgggcgctcttttcactgctctttgcagcaccaatgattcatgcaaccgacactgcaacgaccaaagatggcgaaacaatcactgttacagcggatgcaaataccgcaactgaggcgaccgatggttatcaacctctgagcacttccacggcgacattaaccgatatgccgatgctggatatcccgcaggtggtcaatacggttagcgatcaggttctggaaaatcagaatgcaacgacgctggatgaagcgctttataacgtcagtaacgtggtacagaccaatacattaggcggaactcaggacgcctttgtacgtcgtggttttggtgctaaccgggatggctccatcatgaccaacggcctgcgaactgtacttcctcgcagtttcaacgccgccacagaacgtgtggaagtgctaaaaggtccggcctccacgctgtatggcattctcgatcctggtggattgattaacgtcgtgaccaagcgcccggaaaaaacattccatggttctgtctcagccacgtcctccagttttggcggaggcactgggcaacttgatatcacaggtcccattgaaggcactcagctggcataccgcctgacgggggaagtgcaggatgaagattactggcgaaacttcggtaaagagcgcagtacatttattgccccgtcactcacctggtttggtgataatgcaacagtaaccatgctctattcccatcgggactataaaactccgttcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgacaatcaggctcgcgttaccgcgtatgatgcaacgacaggaacgctgacacggcgtgttgatgcaactcagggatctacccagcgtatgcattctactcgtgcggatctgcaagggaatgttgatattgctgggttctataatgagattctgggtggggtgtcatatgaatattatgatcttctgcgcacagatatgattcgctgtaaaaacgctaaagatttcaatatctacaaccccgtttatggcaataccagcaaatgcacaacggtttcggcgtcggacagtgatcagacgatcaaacaggagagctactcagcttatgcacaggatgcgctctatctgaccgataactggattgccgtcgccgggatccgctatcagtattacacgcagtatgcgggtaaaggccgtccttttaatgtcaatactgacagccgcgatgaacaatggacgcccaaactggggttagtctacaaactgacgccatcggtatccttatttgctaattattcgcaaacatttatgccgcaatcgtcaattgccagctacatcggagatcttccaccggaatcatctaatgcttacgaagtcggggcaaaattcgagctgttcgatggtataaccgcagatattgcgctgtttgatatccataaacgtaacgtgttgtataccgaaagtattggtgatgaaaccatcgccaaaacggcaggccgcgttcgttcaagaggggtagaagtcgaccttgcgggagcattaactgaaaacattaatatcattgccagctacggctataccgatgctaaggttctggaagatcctgattatgcagggaaaccattgccgaatgttcctcgtcataccggttcgctattcctgacctatgacattcataacatgccaggcaataacacactgacgtttggcggtggtggacattgcgtaagccgtcgttcggcaaccaatggggctgactattatctgccaggctatttcgttgccgatgccttcgccgcatacaaaatgaaattgcagtatccggtcacactgcaattaaacgtcaaaaacctgtttgataaaacgtattacacctcttccatcgccacaaataatctggggaatcagattggcgatccgcgtgaagtgcaattcacggtgaaaatggaattttga

SEQ ID NO: 459 - DNA, 870 bp, Escherichia coli 0157:H7
atgcggactctgcagggctggttgttgccggtgtttatgttgcctatggcagtatatgcacaagaggcaacggtgaaagaggtgcatgacgcgccagcggtgcgtggcagtattatcgccaatatgctgcaggagcatgacaatccgttcacgctctatccttatgacaccaactacctcatctacacccaaaccagcgatctgaacaaagaagcgattgccagttacgactgggcggaaaatgcgcgtaaggatgaagtaaagtttcagttgagcctggcatttccgctgtggcgtgggattttaggcccgaactcggtgttgggtgcgtcttatacgcaaaaatcctggtggcaactgtccaatagcgaagagtcttcaccgtttcgtgaaaccaactacgaaccgcaattgttcctcggttttgccaccgattaccgttttgcaggttggacgctgcgcgatgtggagatggggtataaccacgactctaacgggcgttcagacccgacctcccgcagctggaaccgcctttatactcgcctgatggcagaaaacggtaactggctggtagaagtgaagccgtggtatgtggtgggtaatactgacgataacccggatatcaccaaatatatgggttactaccagcttaaaatcggctatcacctcggtgatgcggtgctcagtgcgaaaggacagtacaactggaacaccggctacggcggcgcggagttaggcttaagttacccgatcaccaaacatgtgcgcctttatactcaggtttacagcggctatggcgaatcgctcatcgactataacttcaaccagacccgtgtcggtgtgggggttatgctaaacgatttgttttga

SEQ ID NO: 460 - DNA, 582 bp, Escherichia coli 0157:H7
atggcggttcaaaagaatgttatcaaaggcatactggcaggtacgtttgcgctaatgctgagcggttgtgtcactgtgccggacgccattaaaggcagcagtcccacgccgcaacaagatttagttcgggtgatgagtgcgccgcagctgtacgttggtcaggaggcacgctttggtggcaaagtggttgcggtacaaaaccagcaagggaaaacccgcctggaaattgctaccgtaccgctggacagcggagccagaccgacgctgggagaaccttctcgcggtcgcatttatgccgatgtgaacggttttctggacccggtggatttccgtggacaactggttacggtagtcgggccaatcactggtgcggttgacggaaaaatcggcaacacgccctataaatttatggtgatgcaggcaacaggttacaaacgttggcatttaacccagcaggtgattatgccgcctcagccgattgatccctggttttatggcggtcgtggctggccctatggccacggcggatggggctggtataatcccggccccgcgagagtacaaacagttgtaactgaataa

SEQ ID NO: 461 - DNA, 1089 bp, Escherichia coli 0157:H7
atgcgtaagcagtggctcgggatctgcatcgcggcaggaatgctcgcggcatgtacaagcgatgatggtcagcaacagacagtaagtgtaccgcagcctgcggtatgtaacggccccatagttgaaattagcggggcggacccgcgtttcgaaccactgaacgcgacggcaaatcaggattaccagcgcgacggtaaaagctacaaaatcgtgcaggatccgtctcgatttatccaggcgggactggcggcaatctatgatgccgaaccaggcagtaacctgacggcctctggcgaagctttcgatccgacacagctgacggcggcccatccaacgcttccgatccccagctacgccagaatcactaacctggctaacgggcgaatgatcgtggtgcgcattaatgatcgcggtccttacggcaacgaccgcgttatttcgctttctcgcgcagcagctgaccgtcttaacacgtcaaacaacaccaaagttcgtatcgatccgattattgtcgcccaggatggttcgctttctggtcctggtatggcttgtaccacagtcgccaaacagacttacgccctgcctgcacctcccgatttaagcggtggcgcgggaacaagttcagtgtctggcccgcagggtgacattcttccggtcagtaattcgacgctaaaaagcgaagatccgaccggcgcgccggtaaccagcagcggtttcctcggcgcaccaacgaccttagcgccaggtgtactggaaggcagcgaaccgacgcctgctccacagcccgttgttacagctccgtcgacaacgcctgcaacctcgcctgcaatggtgacaccgcaagccgcctcgcaaagcgccagcggcaactttatggtgcaggtcggggccgtaagcgatcaggctcgtgcgcaacagtaccaacagcaactgggacagaagttcggcgtccccggtcgcgtaactcaaaatggcgcggtctggcggatccagcttggcccattcgccaacaaagccgaagccagtaccttgcagcaacgtttgcaaaccgaagcccaattacagtcatttattaccaccgcgcagtag

SEQ ID NO: 462 - DNA, 468 bp, Escherichia coli 0157:H7
atgattaaacgcgtattggttgtttcaatggtaggtctgtctcttgtcggttgtgttaataacgacaccctgtcaggggatgtttataccgcttctgaagcgaaacaagtacagaatgtcagctatggaaccatcgttaacgtacgtccggtacagattcagggcggtgatgattccaacgttatcggtgcaattggcggtgctgttcttggtggtttcctgggaaatactgttggtggcggaaccgggcgttctctggctactgcagcaggcgctgttgcaggtggcgtagctggtcagggcgtacagagtgcaatgaacaaaacgcaaggtgtcgagctggaaattcgtaaagacgatggtaataccatcatggtggtacagaaacaaggcaacactcgtttctctccgggccaacgtgtcgtactggccagcaatggcagtcaggtgaccgtttctccgcgctaa

SEQ ID NO: 463 - DNA, 1185 bp, Escherichia coli 0157:H7
gtgtcaaaggcaaccgaacaaaacgacaagctcaagcgggcgataattatttcagcagtgctgcatgtcatcttatttgcggcgctgatctggagttcgttcgatgagaatatagaagcttcagctggaggcggcggtggttcgtccatcgacgctgtcatggttgattcaggtgcggtagttgagcagtacaaacgcatgcaaagccaggaatcaagcgcgaagcgttctgatgagcagcgcaagatgaaggaacagcaggctgctgaagaactgcgtgagaaacaagcggctgaacaggaacgcctgaagcaacttgagaaagagcggttagctgctcaggaacagaaaaagcaggctgaagaagccgcaaaacaggccgagttaaagcagaagcaagcggaagaggcggcagcgaaagcggcggcagatgctaaagcgaaggccgaagcggatgataaagctgcggaagaagcagcgaagaaagcggctgcagacgcgaagaaaaaagcagaagcagaagccgccaaagccgcagccgaagcgcagaaaaaagccgaggcagcagctgcggcgctgaagaagaaagcggaagcggcagaagcagctgcagctgaagcaagaaagaaagcggcagcagagaaagctgcagccgacaaaaaagcagcagaaaaagcggctgctgaaaaggcagcagctgataagaaagcagcggcagaaaaagccgccgcagacaaaaaagcggcagctgcaaaagcagcagctgaaaaagccgctgcagcaaaagctgccgcggaggcagatgatattttcggtgagctaagctctggtaagaatgcaccgaaaacggggggaggggcgaaagggaacaatgcttcgcctgccgggagtggtaatactaaaaacaatggcgcatcaggggccgatatcaataactatgccgggcagattaaatctgctatcgaaagtaagttctatgacgcatcgtcctatgcaggcaaaacctgtacgctgcgcataaaactggcacccgatggtatgttactggatatcaaacctgaaggtggcgatcccgcactttgtcaggctgcgttggcagcagctaaacttgcgaagatcccgaaaccaccaagccaggcagtatatgaagtgttcaaaaacgcgccattggacttcaaaccgtaa

SEQ ID NO: 464 - DNA, 519 bp, Escherichia coli 0157:H7
gtgatgaaatttaaaaaatgtcttctgcctgtggcaatgttagcgtcattcactctggcaggatgccagtcaaatgctgacgatcatgccgccgatgtttatcaaaccgatcaactgaataccaaacaagaaactaaaaccgttaatattatttccattcttcccgcaaaagttgccgtagacaactcccaaaataaacggaacgcacaagccttcggcgcgcttattggcgcagtcgctggcggtgttatcggccacaacgtcgggtctggcagcaattccggaacgacggcaggtgcagttggcggcggagctgtaggcgcggcagcgggttctatggtgaatgataaaaccttagtggaaggtgtttctttaacgtataaggaaggcaccaaagtgtatacctctactcaggtgggtaaagagtgccagtttacgacaggtttagccgttgttattaccacgacgtataacgaaacgcgtattcagccaaataccaaatgtcctgaaaagagctaa

SEQ ID NO: 465 - DNA, 747 bp, Escherichia coli 0157:H7
atgttgcttagcataatcactgtcgcgtttcgtaacctcgaagggatagtcaaaacacatgcctcgctggcgcatctggcgcaggcggaagatatcagcttcgaatggattgttgtcgatggcggttccaatgacggcactcgtgagtacctggaaaatctcaatggtatctataacctacgctttgtcagcgagccagataacggtatctacgacgccatgaacaagggcattgcgatggcacaaggcaagttcgcgttgtttctcaactcgggcgatatttttcatcaggatgccgcatattttgtccgtaagttaaaaatgcaaaaagataacgtgatgatcaccggcgatgcgctgctggattttggcgacgggcataaaattaaacgtagcgccaaaccgggctggtatatttatcacagcctgcccgccagtcatcaggcgatatttttcccggtatccggtttgaaaaaatggcgttatgacctggaatataaagtttcttctgattacgcgctggcagccaaaatgtataaagcaggttatgcatttaaaaaactcaatggcctggtgtctgaattttctatgggtggggtatctaccaccaataatatggaattgtgtgctgacgcgaaaaaagtccaacggcaaatattacatgtgcctggcttttgggctgaattatcctggcatttacgccagcgtactacctcaaagacgaaagccttatataacaaaagctga

SEQ ID NO: 466 - DNA, 450 bp, Haemophilus influenzae Rd
atgaaattaacaacactgcaaaccttgaaaaaagggtttacattaatcgagctaatgattgtgattgcaattattgctattttagccaccatcgcaattccttcttatcaaaattataccaaaaaagctgcggtatccgaattactgcaagcgtctgcgccttataaggctgatgtggaattatgtgtatatagcacaaatgaaacaacaagctgtacagggggaaaaaatggtattgcagcggatataaagacagcaaaaggctatgtagcctcagttatcactcaatcaggtggtattacagtaaaagggaatggcacattggcaaatatggaatatattttgcaagctaaaggtaatgctgcagcaggtgtaacttggacaacaacctgcaaaggaacggatgcctctttatttccagcaaatttttgcggaagtgtcacaaaatga

SEQ ID NO: 467 - DNA, 5085 bp, Haemophilus influenzae Rd
atgctaaataaaaaattcaaactcaattttattgcgcttactgtcgcctacgcattaaccccttatacagaagctgcgttagtgagagacgatgtggattatcaaatatttcgtgattttgcagaaaataaagggagattttctgttggtgcaacaaatgtggaagtgagagataaaaataaccactctttaggcaatgttttacctaatggcattccgatgattgattttagtgttgtggatgtagataaacgcatcgccacattgataaatccacaatatgtagtaggtgtaaaacacgttagtaacggcgtgagtgaactacattttgggaacttaaatggcaatatgaataatggcaatgctaaatcgcaccgagatgtatcttcagaagaaaatagatatttttccgttgagaaaaatgagtatccaactaaattgaatggaaaagcagtaactactgaagatcaaactcaaaaacgccgtgaagactactatatgccacgtcttgataaatttgttaccgaagttgcaccaatagaggcttcaactgcaagtagtgatgctggcacatataatgatcagaataaatatcctgcttttgtaagactaggaagtggtagtcaatttatttataaaaaaggagataattacagcttaattttaaataatcatgaggttggaggcaataatcttaaattggtgggcgatgcctatacctatggtattgcaggcacaccttataaagtaaaccacgaaaataatggactaattggttttggcaattcaaaagaggaacacagcgatccaaaaggaatattatctcaagatccgcttaccaattatgctgttttaggcgacagtggctccccattatttgtatatgatagagaaaaaggaaaatggctttttcttgggtcttatgatttttgggcaggttataacaaaaaatcttggcaagaatggaatatttataaacctgaatttgcaaaaactgttctagataaagatactgcaggttctttaactggttctaacacccaatacaattggaatcctactggcaaaacaagcgttatttctaatggttctgaatctctaaatgttgatttattcgatagtagtcaggatactgactctaagaagaacaatcacggaaaaagtgtgactcttagaggaagtggaacgcttaccttaaataataatatcgatcaaggcgcaggcggcttgttctttgaaggagattatgaagttaaaggcacttctgatagtaccacttggaaaggagctggcgtttctgttgctgatggaaaaacagtaacgtggaaagtacataacccgaaatctgatcgtttagctaaaatcggcaaaggaacattaattgtagaaggaaagggagaaaataaaggttcgctaaaagtgggcgatggtactgttatcttaaaacaacaagctgatgccaataataaagttaaagccttttcacaagtaggtatagtaagtggtcgctcaactgttgtacttaatgatgataagcaagtagatccaaattccatttactttggctttagaggtggtcgattagatgccaatggcaataatctcacttttgaacatatccgtaatattgatgatggcgcaagactagtaaatcacaataccagcaaaacctctactgtaacaattactggggaaagtctaattacagatccaaatacaattactccatataatatagacgcaccagatgaagataatccttatgcctttcgacggattaaagatggaggacagctctatttaaatttggaaaattacacttattatgcgttaagaaaaggtgcgagcactcgttcagaattacctaaaaatagtggcgaaagcaatgaaaattggctatatatgggtaaaacttccgatgaagccaaaagaaatgtaatgaaccatatcaacaacgagcgtatgaatggctttaacggttattttggcgaggaagagggtaaaaataacggtaatctaaatgtgacttttaaaggcaaaagtgagcaaaatcgctttttattaacaggcggaacaaaccttaatggcgatttaaaggttgaaaaaggcacattattcctttctggcagaccaacaccgcacgcaagagatattgcaggtatttcttcgacaaaaaaagatcaacactttgctgaaaataatgaagtggtagtagaagatgactggattaaccgcaattttaaagcaacaaatattaatgtaaccaataacgcaaccctttattcaggtcgcaatgttgcaaacattacttcaaatatcacagcttctgataatgcaaaagtacatattggctataaagcaggcgataccgtttgtgtacgttctgactatacgggctatgtgacttgcactactgacaagttatccgataaagcccttaatagctttaacgccaccaatgtatctggcaatgtaaatttatcaggtaatgcaaactttgtcttaggcaaagctaacttattcggcacaattagcggcacgggaaatagccaagtacgtttaaccgaaaatagccattggcatttaacaggcgatagcaatgttaatcagttaaatttagacaaggggcatattcatttaaatgcacaaaacgatgcaaataaagtaactacatataacacgctgactgtgaatagcttatcaggtaacggttctttctattatttaactgatctttccaataaacaaggcgacaaagttgttgtaactaaatccgccacaggtaactttacattacaagtggcagataaaacaggcgagcctacaaaaaatgaactcacgctttttgatgcgtcaaatgctacaagaaataatttgaatgtgtcattagttgggaataccgttgatttaggtgcttggaaatataaattacgtaatgttaatggacgttacgatttgtataacccagaggtggaaaaaagaaatcaaactgtcgatacgacaaatatcacaacacctaataatattcaagctgatgtgcctagcgtaccaagtaacaatgaagaaatagcccgtgttgaaacaccagttccaccacctgcgcctgctacaccatcagagacaactgaaacagtggctgaaaatagtaagcaagaaagtaaaacagtagagaaaaacgagcaagacgcaaccgagacaacagctcaaaatggagaagttgcagaagaagctaaaccaagtgtaaaagctaatactcaaacaaatgaagtggctcaaagtggaagtgaaaccgaggaaactcaaacgactgaaataaaagaaacagctaaagtagaaaaagaggaaaaggctaaagtagaaaaagatgaaattcaagaagcacctcaaatggcttctgaaacgtctccgaaacaagcaaagcctgctcctaaagaagtttcaactgatacgaaagtagaagaaactcaagttcaagctcaaccgcaaacacaatcgacaactgttgctgcggcagaggcaacttcgccaaacagtaaaccagcggaagaaactcaaccaagtgaaaaaactaacgctgaacctgtaacgcctgtagtatcaaaaaatcaaacagaaaatacgaccgaccaaccaacagaaagagagaaaacggctaaagtagaaacagagaaaactcaagaaccccctcaagtggcttctcaagcgtctccgaaacaggaacagtctgaaactgttcaaccgcaagcagtgcttgaaagtgaaaatgttccgactgttaataatgcagaagaagttcaagctcaactgcaaacacaaacaagtgcaacagtaagcactaaacaacctgcaccagagaattcaataaatactggatctgcaaccgcaataacagaaactgctgaaaaatccgataaaccacaaacggaaactgcggcttcgactgaagatgctagtcagcataaagcgaatactgttgcggataattctgtagcaaataattcagaaagcagtgatccaaagagtagacgtagaagaagtattagccagcctcaagagacttctgctgaagaaacaacagcagcttctactgacgaaacaacaatagctgataattcaaaacgcagtaagccaaatcgtagaagtagaagaagtgttcgctcggaaccaactgttacaaatggcagcgatcgttctacagtagcattgcgcgatctcacaagtacaaacacaaatgcggtaatttctgatgcaatggcaaaagcacaatttgttgcattaaatgtggggaaagcagtttctcaacatattagccagttagaaatgaataacgaggggcaatataacgtttgggtatctaatacttcaatgaacgaaaattattcctcaagtcaatatcgtcgttttagttctaaaagtacgcaaactcaacttggttgggatcaaacaatctcaaacaatgttcagttaggtggcgtgtttacttatgttcgcaatagtaacaactttgataaggcaagcagtaaaaatactctagcacaagttaatttctattctaaatattatgcggataatcattggtatttgggcattgatttaggctacggcaagttccaaagcaacctaaaaaccaatcataatgcgaaatttgctcgccatactgcacaatttggtttaaccgcaggcaaagcatttaatcttggcaattttggtattacgccaatagtaggcgtgcgttatagctatttatcaaacgctaattttgcattagctaaagatcgcattaaagtaaatccaatatctgtcaaaacagcctttgctcaagttgatttaagttatacttatcacttaggcgagttttccgttacgccaattttgtctgctcgatatgatacaaatcaaggcagcggaaaaattaatgtaaatcaatatgattttgcttacaacgtggaaaaccaacagcaatataacgcagggcttaaattgaaatatcataatgtgaaattaagtctaataggcggattaacaaaagcgaaacaagcggaaaaacaaaaaactgcagaattaaaactaagttttagtttttaa

SEQ ID NO: 468 - DNA, 600 bp, Haemophilus influenzae Rd
atggcattagtaaacaaaattaaaacattatcatcagtaggtattctagcggctacattatttcttgcaggctgccaagcacaatcaaatatattagcatttacaccgcctgcaccaagtgcttcaatgaatgttaatcgaactgccgttgtatctgtgacaacaaaagatagccgtgcaatacaagagattgcgagttatacgaaacacggggaactgattaaattaaatgcatccccaagtgttacacaattatttcagcaagtgatgcagcaaaatttaattagtaaaggttttagagttgggcaattaaatggttcaaatgcgtgggtaactgtggatgtgcgtgaatttggtacgcaagtagaacaaggtaatcttcgttataaacttaataccaaaattcaagcgacagtttatgtacaaggtgcgaaaggttcgtataataaatcatttaatgtcacgcactcacaagagggcgtatttaatgcgggcaatgatgaaattcataaagtgctatctcaaacttttaatgatattgtgaacaatatttatcaagatcaagaagttgcggctgcgataaaccaatattctaattaa

SEQ ID NO: 469 - DNA, 612 bp, Haemophilus influenzae Rd
atgctgtgctggattggctacaaaaatgggattttaccgcagcagaacagcacgctatatccttggctgaatccgtcaaagtgcggcgtaatttttgatggttttcaacttgtgggcgatgatttcaattcagatcaaacggctgaaaatacatcgccagcttggcaagtgctttacacaacccatttacaaagttgctcgccgattcatagtggagaaaatttcgcacccatccctttgtataaacaactaaaaaatcaaccgcacctaagccaagatctgattaaatggcaagaaaattggcaagcctgcgatcaactacaaatgaatggtgcggtattagaacaacaatctttggcagaaatttccgatcatcaaagtacgctttcaaaacacggacgatatttagctcaagaaatagaaaaagaaactggcataccgacttactattatttatatcgtgtaggtgggcaatctttagaatctgaaaaatcccgttgctgcccttcttgtggtgcaaattgggcgttaaaagacgcgatttttgatacctttcattttaaatgcgatacctgtcgattagtttcgaatctatcgtggaattttttgtaa

SEQ ID NO: 470 - DNA, 486 bp, Haemophilus influenzae Rd
ttgggtgcatttgcctttgcttctgttacaaatgcgaatatttatgctgagggcgatatcggtttatctcaaactaaagcaaacggtagtaacaatacaagagttggacctcgcgtatccgtgggttataaagtaggaaatacacgtgttgcgggtgattatactcatcatggaaaagttgatggcacaaaaattcaaggtttaggtgcatcagtattatatgattttgacacgaattctaaagtgcaaccttatgttggtgctcgtgtagcgactaatcaatttaaatacaccaatcgcgcagaacaaaagtttaaaagttcttctgatattaagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacggattctaa

SEQ ID NO: 471 - DNA, 2388 bp, Haemophilus influenzae Rd
atgaaaaaacttctaatcgcaagtttattattcggtacgacaacgactgtgtttgccgcaccttttgtggcaaaagatattcgtgtggatggtgttcaaggtgacttagaacaacaaatccgagcaagtttacctgttcgtgctggtcagcgtgtgactgacaatgatgtggctaatattgtccgctctttattcgtaagtggtcgattcgatgatgtgaaagcgcatcaagaaggcgatgtgcttgttgttagcgttgtggctaaatcgatcatttcagatgttaaaatcaaaggtaactctattattcccactgaagcactaaaacaaaacttagatgctaacgggtttaaagttggcgatgttttaattcgagaaaaattaaatgaatttgccaaaagtgtaaaagagcactatgcaagtgtaggtcgctataacgcaaccgttgaacctattgtcaatacgctaccaaataatcgcgctgaaattttaattcaaatcaatgaagatgataaagcaaaattggcatcattaactttcaaggggaacgaatctgttagtagcagtacattacaagaacaaatggaattacaacctgattcttggtggaaattatggggaaataaatttgaaggtgcgcaattcgagaaagatttgcagtcaattcgtgattattatttaaataatggctatgccaaagcacaaatcactaaaacggatgttcagctaaatgatgaaaaaacaaaagttaatgtaaccattgatgtaaatgaaggtttacagtatgaccttcgtagtgcacgcattataggtaatctgggaggtatgtctgccgagcttgaacctttactgtcagcattacatttaaatgatactttccgccgtagtgacattgcagatgtagaaaatgcaattaaagcaaaacttggagaacgcggttacggtagcgcaacggtaaattcagtacctgattttgatgatgcaaataaaacattagcgataacccttgttgttgatgctggacgacgtttaactgttcgccaacttcgctttgaaggaaataccgtttctgctgatagcactttacgtcaggaaatgcgccaacaagaaggaacttggtataattcacaattagttgagttaggaaaaattcgcttagatcgtacaggtttcttcgaaacagtcgaaaaccgaattgatcctatcaatggtagtaatgatgaagtggatgtcgtatataaagtcaaagaacgtaacacgggtagtatcaactttggtattggttacggtacagagagtggtattagttatcaagcaagtgttaaacaagataatttcttgggaacaggggcggcagtaagtatagctggtacgaaaaatgattatggtacgagtgtcaatttgggttataccgagccctattttactaaagatggtgtaagtcttggtggaaatgttttctttgaaaactacgataactctaaaagtgatacatcctctaactataagcgtacgacttatggaagtaatgttactttaggtttccctgtaaatgaaaataactcctattatgtaggattaggccatacctataataaaattagtaactttgctctagaatataaccgtaatttatatattcaatcaatgaaatttaaaggtaatggcattaaaacaaatgactttgatttttcttttggttggaactataacagccttaatagaggctatttcccaactaaaggggttaaagcaagtcttggtggacgagttactattccaggttctgataacaaatactacaaactaagtgcagacgtacagggtttctacccattagacagagatcacctctgggttgtatctgcaaaagcatctgcaggatatgcaaatggttttggaaacaagcgtttaccgttctatcaaacttatacagcgggtggcatcggttcattacgtggttttgcttatggtagtattggacctaacgcaatttatgcagaacatggtaatggtaatggtacttttaagaagataagttctgatgtgattggtggtaatgcaatcacaactgcgagtgcagaacttattgtaccaacaccgtttgtgagtgataaaagccaaaatacagtccgaacctccctatttgttgatgcggcaagtgtttggaatactaagtggaaatcggataagagtgggttagataacaatgtattaaaaagcttacccgattatggcaaatcaagccgtattcgcgcctctacaggtgtcggattccaatggcaatctcctattgggccattggtattctcttatgccaaaccaattaaaaaatatgaaaatgatgatgtcgaacagttccaatttagtattggaggttctttctaa

SEQ ID NO: 472 - DNA, 405 bp, Haemophilus influenzae Rd
atgttgaaaaaaacatctcttatttttaccgcacttttaatgactggctgtgtgcaaaatgcgaatgtaacaacacctcaagcgcaaaaaatgcaagtagaaaaagtggataaagccttacaaaaaggcgaagctgatcgatatttatgtcaagatgatagagttgttcgtgttgtacacgccacgcataaaaaatacaaaaaaaatttgcattatgttactgtcacttttcaaggcgtatcagaaaaactaaccttaatgatttctgaacgtggtaaaaattacgccaatattcgttggatgtggcaagagcgtgatgattttagtacgctaaaaacgaatctcggcgaaattttagcaacgcaatgtgtctcacaaacaagtgaacgcttatctggacaataa

SEQ ID NO: 473 - DNA, 3033 bp, Haemophilus influenzae Rd
ttgagaattattattattttttttatgggattaaatatgaccaattttagattagaacgtgcttgcctattccgttatgcttgggctaacggcaggtgttgcttatgcagctcaaccaaccaaccaaccaaccaaccaaccaaccaaccaaccaaccaaccaaccaaccaaccaaccaaccaaccaaccaaccaaaatagtaatgtttctgaacaactagaacaaataaatgtatctggttctaccgaaaatagtgatacaaaaacaccaccaaaaattgctgaaacggtaaaaacagctaaaacgctggaaagagaacaagcaaacaacattaaagacatcgttaaatacgaaacgggcgttactgttgttgaagctggacgttttgggcaaagcggttttgccattcgtggtgtagatgaaaatcgtgtagcgattaatattgatggattacgtcaagctgaaaccttatcttctcaaggctttaaagagctttttgaaggttatggtaatttcaataacacgcgtaatggtgcagaaattgaaaccttaaaagaagtaaatatcacaaaaggggctgattctattaagaatggtagtggttccttaggtggttctgtaatttataaaacaaaagatgcgagagattatctcataaacaaggattactatgtaagttacaaaaagggatacgctacggaaaataatcaatcattcgatacccttactcttgcaggacgttataaaaagttcgatgtgctagtggttacaacaagcagaaatgggcatgaacttgagaactatggttataaaaattataacgataaaattcaaggtaaaaaaagagaaaaagcagatccatataaaattgaacaagatagtacattattaaaattatctttcaatcctacagaaaatcatcgttttacctttgccgctgatttatatgaacatcgttctcgtgggcaagatttatcctatacattaaaatatcaacgtagtggtaatgaaacccctgaagttgattctagacacaccaatgataaaacaaagagacgtaatatttcatttagttatgaaaatttctctcaaactccattttgggatacgctaaaactcacttattctgatcaacgtattaaaactcgtgcacgcacagatgagtattgtgatgctggtgtaagacattgtgaaggcacagacaatcctacgggactaaaagtaacaaatgggaaaataacacgtcgagatggttcagaccttcaatttgaggaaaaaaacaatacagctaagagtagtgataaaacctatgacttcaagaaatttattgatactgataagagagtaatagacgataaactagtcctaaacaacccctctgacacttggtatgattgttcaatatttaattgtgaaaataacgcaaaaataaaagtttttaaaggtaacaattattatggctatgatggaaaatggaaagaagttgaccttgaaataaaagaattaaatggcaaaaaattcgctaaaataaaggataatgataggaaaataaaatctattcttccctcttcacctggttatttagaacgcctctggcaagagagagatttggacaccaacacccaacaattaaatttagatttaaccaaagacttcaaaatttggcatattgaacataatctacaatatggtggatcatataataccgcgatgaagcgcatggttaatcgtgctggcaacgatgcttctgatgtgcaatggtgggcaacacctacgcttggtgaggattcttggactggaaaacctcacacttgtgcaacgacttatgagtggaatgctaacctttgtcctcgagttgatcctgaattttcttacttattacccattaaaacaacaggaaaatcagtctatctctttgataattttgttataactgattatttatcttttgatttgggttatcgttatgacaatatccattatcaaccaaaatataaacacggtatcacacccaaattacccgatgatattgtgaaaggattatttattccattaccaaacaattcaaattcagatcctaataaagttaaggaaaatgtacaacaaaatattgactatatcgccaaacagaacaaaaaatataaagcacattcttatagttttgtttcaaccattgatccaacgagttttcttcgtttacaactaaaatattctaaaggttttagaacaccaacttcagatgaaatgtatttcacctttaaacaccctgatttcactattttgccaaatactgatttaaaaccagaaatagcaaaaaccaaagaaattgctttcacattacataatgatgattggggatttatctcgacaagtctgtttaaaactaactataaaaactttattgacctaatatttaaaaagcaagaaacttttaaagtaggcggctctggaagaggtgaaacattaccattttctctttatcaaaatataaatagagataatgcgtctttaaaaggtattgaaattaattcaaaagtattccttggtaaaatggcaaaatttatggatggatttaacctaagctataaatatacctatcaaaaaggcagaatgaatggcaatattcctatgaatgcaattcagcctagaactatggtatatggtttaggatatgatcatccaaatcataaatttggtttcgatttctatacgacacatgtagcaagtaaaaatccagaagatacttataatatgttctataaagaagaaaataaaaaagacagcacaattaaatggagaagcaaatcttatactattctagatttaattggatatgtacaaccaattaaaaatttaaccataagagctggtgtatataatcttacaaaccgtaaatacattacttgggattctgctcgttcaattcgttcatttggaacaagtaatgttatagatcaatcaacaggattaggcattaaccgcttctacgcaccaggtagaaattataaaatgtcagttcagtttgaattttaa

SEQ ID NO: 474 - DNA, 9585 bp, Helicobacter pylori J99
atgacttatagaaatggcaaaatagatttaaaggaacgctttagtaaaaaccgctcttttaagggcattaaaaagaaaatcgctaaaaaatatacaatcaaaaactcgctttctataatttattccttaaaaacgcattcaaattcttctctatccattaataaaaaaatcttcttagggctagggttcgtttcggctttgagcgctcaaagtgaagattataatagttcggtgtattggctcaatagcgtgaatgaaaacaataataacaaatcctactatattagccccttacgcacttgggctggggggaataggagttttacgcaaaattataacaatagtcaattatacatagggacaaaaaacgcttccgcaacgcccaatcattcttctgtgtggtttggagaaaagggctatatcggttttattacaggggtttttaaggctagagacatttttatcacaggagctgttggatcgggtaatgagttaaaaaccggtgggggggcgatactggtttttgaaagctcaaacgaactaaccactaacggggcttattttcaaaataacagagccgggacacaaacttcttggatcaatttgatttccaataacagcgtgaatttgacaaacacggattttggcaatcaaacccctaatgggggctttaatgttatggggcgaaagattacttataatggtgggagcgtcaatggtgggaattttggctttgataacgtggatagcaatggcgcaaccaccattagcggggtaactttcaacaataacggtgcgctcacttataagggtgggaatggtattggagggagcatcactttcactaactctaatatcaatcattacaagctcaatcttaacgctaatagcgttacctttaataacagcactctagggagtatgcctaatggcaacgctaacactatagggaatgcctacattcttaatgcaaataatattacttttaataatttgacctttaatgggggttggttcgtttttaatagatctgatgctcatgttaattttcaaggcacaactacgatcaataaccccacttcaccctttgtcaatatgaccggtaaagttaccattaatcctaatgcgatttttaatattcaaaattacacgcccacgatagggaacgcttacacgctctttagcatgaaaaatggcaatatcgcttatgatgatgtgaataatttatggaatattatcaggcttaaaaacacgcaagccacaaaagacaatagcaaaaacgccacttccaataacaacacccacacttactatgtaacttacaatttaggcggcacgctctatcatttcaggcaaatttttagccctgattccattgttttacaatccgtctattatggcgcgaataatctttactacaccaatagcgtgaatatccatgacaatgtctttaatttaaaaaatattaacgatgatagggctgatacgattttttatcttaatggcttgaacacttggaattacacgcaagcgagattcgctcaaacctatggcgggaaaaacagcgctttagtctttaacgccacgactccttgggctaatggtgcgatccctaaatctaacagcacggtgcgttttggggggtatgagggagtcaattgggggaaaacgggctatatcaccggcactttcacagccgatagggtttatatcaccggtaacatgatgtctggcaatggcgctcaaaccggtgggggggcgactttgaattttgtgggcgcgactgaaattaatatcgctggagccacttttaaaaacttaaaaaccacttcacaaaactcttacatgacttttatggcgttagggaatggctctgggagtggtaagatcaatgtttctcagtctgatttttacgattggacggatggagggtatgattttaccggtaatggcgtttttgacagcgtgaatttcaacaaggcttattacaaatttcaaggcgctgaaaattcttacaattttaaaaacacgaattttttagcagggaatttcaaattccagggcaagaccaccattgaaaaatccgttttaaacgacgcttcttacgcttttgatggcgtgaataacgcctttaatgaagacaaatttaatggcggatcgtttaatttcaaccacgcagagcaaacaaacgcttttaataacaactcgtttagtggcggatcgtttagttttaacgccaagcaagtggattttaatgggaattcgtttaatgggggggtgtttaatttcaataatacccctaaagccagttttactaacgacacttttaatgtgaataaccaattcaaaataaatggcgctcaaacggattttactttcagtaagggcgttgttttcaacatgcaagggcttttgagcagtttgagcgtaggcacgacttatcaattgcttaacgctaaaagcgtgggttataaggataacaataacgctttgtatcaaatgttgcgctggactagcggagaaaatcctagcggtaaattagtagatgaaaataaaaccgcgccaaacagcgctaaaatttataatgttcaattcactgataacggcttgacttactacattaaagaaaattttaataatgggatcacgctcactcgtttatgcactctaggctacacgcattgcgtgaatattgataacgatgcgtttaatcttaaaaatgtcaataataacgctagtaacaccgtgttctatctcaacggcatgacgacttggaagactgctggcacaggagttttcacgcaagattacagcggcactaacagcgttttagtgttcaatcagaccaccccttttcttgctggggcgaatcccacttccaatagcgtggtgggttttgggaaaacttcaggggctgaatgggggctagtgggctatattcaaggcgtttttaaagccaatcaaattgatattaccggcacgattcgctctggtaatggagccaaaaccggtgggggcgcgactttagtgtttaacgctcaagagcgtttgaatatcgctaacgctaatttgaataacgataaagccggtttgcaaaactcatggatgaatttcattgttaataatggcaatttgaacgtaacaaacgcaaattttagcaaccaaaccccgcatggaggctttaaccttaaagccaataatatcacttgggataaaggctctgtgagtgggggggggaattttggtgtggataacgccaacgctaatgggaatgcggtgattaagaatgttaatttcagcgataacggcactttgatttataaagggggtgaaaacagcgccggaaattccctgaccttagaaaacaacaccttcaattcctataatatcaacgccaaagcgcaaaaccttattttcaacaacaactcgtttaacagcggtagctattcgtttaacgacactaaaaatgttacttttaaaggcacgaacacgctcattaacagcgatcctttcagccgccttaaaggatcagtttctattgacaataatagtatctttaacattgaaagggatttgaccgataaaaccacttacacgcttttaagtggggataacatcaaatacaataaccaagctttagcggataatgttttttcaaaaaatttatgggatttgatccattatgacggcgaacaagggactctattaagaacggataacaacacttattttgtgcaattcacgcagagcaacggccaaaaatttgtttttgaagagacttttaatcctggctctatcacctataaatatttcactatccattcttcgcctttccacacagaagctgattctaaggatatttggaatcaggtgaggaagcagtttgattttattccaggaaaaaccccggtgtgcgttggcgtgtgctatatcgcaccctataaaaatcaagatcttatcggctctagcgcttttgcgtggtcgctgaattttggggctacggtggtggggactttgcttttagggagcgctcaagaaaaagccaataacaatggcggctcgatctggtttggtaagaataatttgctgtatttgcatggcaattttaacgcgactaatatctttttaacgaataactttaatgtcggcaaccctaacgccggcggtggggcaacgattaattttaacgctgatgaaaccttgagcgctgacgggttgaattacacgaatttccaaaccgtggctatgggcttacaaactagcgcgagccagcattcatgggcgaattttaattccaagctttctatggagattaaaaactccaactttagggatttcacatggggaggctttaggttcaattcagggcgtatcacttttgaaaacaccacttttagcggctggactaatattaacggggcgactgaaagcggttcatcgtatgtgaacatggttgcgaatacggatttgattttcactgattccattttaggagggggcattcgctatgatttgaaggctaataacattattttcaataacactcaaatggtggttgatgtgtctaaaaacgtgaatcagtcttcattgaatgggaatgttactttcaatcattccaggctttcagtcaaacccaatgcggctatcaatattgggggggatcagacccaaacgactttagaaaacgcttcaagcctttctttttataacgatagcgtagcgaattttaacggcacgaccgcttttaacggggtgtcttacttgaatttaaaccctaacgctcaagtcagcttcaatcaagcgaatttcaataacgctaatgtaaccttttatggcattccgctatttggtaaaacgcccaattttggcaactctgtgcgccttatcaatttcaaaggggacgcaaagtttaatcaagccacgctcaatttaagggctaaaaatatccatttgaatttccaaggggcttccacttttgaaaataactctacgatgaatttggctgaaagttctcaagcgagctttaacgctcttagcgtggagggggaaacgaatttcaatctcaacggctcaagtttattgagtttcaatggtaacagcgtttttaacgcccctgtgaatttctacgctaataattctcaaatttctttcactcattcggcgacttttaatgcagacgcttcatttgatttaggcaataacagcaccctgaattttcaaagcgttcttttaaacagcgctctaaaccttttaggcaatggcggtaacaatctagcgattaatgctaaagggaattttagttttggatctcaagggattttgaatctgtcttatatgaatctatttggaggggataaaaaagcttccgtttatgatgtgttgcaagcccaaaatattgatggcttaagggggaataacggctatgagaagatccgtttttatggcatacagattgaaaaggccgattactcgttcaataatggcgttcattcttggagcttcactaacccgctcaacacgactgaaaccattaccgaaaccttacataataaccgcttgaaagtgcagatctctcaaaacggtgcttctaataatgcgatgtttaatctcgctcctagcttgtatgattaccaacaaaacccttatgatgaaagcgagaattcctataatcacacaagcgataaagccggcacttattatttgagtagcagtatcaaaggctttggtaagaataatgaaatacccgggacttataacgcgcaaaaccaacccttacaagctttacacatttataatcaggctatcagtaagcaggatttgaacatgatcgccagtttgggtaaggaatttttgcctaaagtggctaaacttatcgcttcaggggctttagacaatctcaatctcaatagcccggatagctttgaaacgatttttagtatcttaaaagaatatggcattactttaaaccaagcgaattggaagagcttattgaagatcatcaataatttttctaacacggctaattatcatttttctcaaggtagtctcgttgtgggggcgatcaaagaagggcaaacgaacacgaatagcgtggtgtggtttgggggcgatgggtataaaaatccatgcgcggttggggataacacttgccagatgttcaggcagactaatttagggcagttgcttaattctagcgtgccttatttgggttacattaacgctaattttaaggctaaaaacatttatatcaccggaaccatcggcagtgggaacgcttgggggagcggagggagcgcgaatgtgtcttttgaaagcgcgacaaatttggtgcttaatcaagccaatattgacgctcaagggaccgataagatcttttcttacttgggcaaagagggcattgataagctttttggagaaaaaggtttagggaatgtgctttctaatattgtttatgaagagagcttgaatgataacgctatccctaaagatttagccaacatgatccctaaagatttgggatctaaaactttaagctctttgcttagccctactgaagtgaataacctcttaggcgtgagtgcttttaaaaacgcgatcatggaaatcttaaattctaaaacggtgggcgatgtttttggtgaaaacgggcttttaaacgcgctagatcctgtaaaaagaaaagaaattgatcaaatgcttttagagcaaatccaagcccattcttcagggtttgaaaaattcatcgttaaaactttagggattgaaaatgtagagaatttcatcaataactggtatggcaagcaaagcttgagttcttttgccaataattttgtgcctggaggcttgaatcaagccctagataaaataggttctagctctgatgccaaagacttacagagtttcttagataaaacgacttttggggatattctcaatcaaatgatcaatcaagcccctttaatcaataagctcatttcttggctcggcccgcaggatttgagcgtgttagtgaatatcgctttaaatagtatcactaaccctagtaaggaattattgggtgcgatttctggcatgggtcaaaaagtgctgaacgatttgctaggcgaaggtgtagtgaataaaatcatgagcaatcaagttttagggcaaatgatcaataaaatcatcgctgataagggctttggaggcgtttatcatcaaggtctaggctcaatactccctaaatccttacaagatgagttgaagaaattgggtatgggctctttactcaaacctaaaggcttgcacaacctctggcaaaaagggaacttcaatttcgtggctaaaaaccatgtgtttgtgaataacagcttgtttagtaacgccacagggggggaattgaattttgtagcgggcaagtccattatttttaatgggaaaaacaccattaatttcacgcagtatcagggcaggctttcttttgtatctaaagatttttctaatatttcattagacactttaaacgctaccaacggcttaacgcttaacgcttctaaaaatgatattagcgttcaaaaaggtcaaatttgcgtgaatgtcttagattgcatgaccgctaaagggaaaaccactcaaactaattcctcttcaagcgcgacagccccaactaatgaaacgctagaagtgagtgcgaataatttcgctttcttaggcaccattaaggctaatggattagtggatttttcaaaagtcttacaaaatacgactatcgggactttggatttagggccaaacgctacttttaaagcgaataatttgatcgtgaataacgcttttaataataactctaattacagggctaatatcagcggtaatttcaatgtggccaagggtgcaacttttagcacgaatgaaaatggtttgaatgtgggggggaattttaacagcgaagggccattaatctttaatcttaataaccccacccatcaaacgattatcaatgtaactggcacttctacaatcatgtcttataacaatcaagctttaatcaactttaacacccaactcaagcaaggcgcttatacgcttattaacgctaatcgcatggtttatggctatgataatcaaacgattcttggggggagcttgagcgattacctcaaactttacactctcattgattttaacggcaaacgcatgcaattgaatggcgattcgttaagctatgacaaccaaccggtcagtattaaagatgggggtcttgtggtaagctttaaagacaatcaagggcaaatggtgtattcatctatcctttatgataaaatccaagttaccgtctctgataaacccatgagcattcaagcccctagtttggagtattatgttaaacgcattcaaggtagtgctggtttgaatgcgatcaaatctgcgggcaataattccattatgtggttgagtgagctttttgcggctaaggggggtaatcccttgttcgccccttattatttgcaagacaatcccactgaacacattgttactttaatgaaagatattaccagcgctttaggaatgctctctaactccaatctcaaaaacaactccactgatgttttacagctcaacacttacacgcaacaaatgagccgtttagccaagctttctaatttcgcttcttttgattcaacggattttagcgaacgcttgagcagtcttaaaaaccaaagatttgccgatgctgtccctaatgcgatggatgtgattttaaaatactctcaaagggataaactaaaaaacaacctttgggcgaccggtgttgggggcgtgagctttgtggaaaatggcacaggaacgctctatggtgtcaatgtgggctatgatcgctttgttagaggggtaattgttggagggtatgcggcttatgggtatagcgggttttatgagcgcatcactagttctaaatccgataatgtggacgtgggtttgtatgctagggcttttatcaaaaagagcgagctgacttttagcgttaatgaaacttggggggctaataaaacccaaatcagctccaacgacgctttgctttctatgatcaatcagtcctataaatacagcacatggacaacgaacgcgaaagttaattacgggtatgatttcatgtttaaaaacaaaagcatcattttaaaacctcaaattggtttaaggtattactatattggtatgagcggtttagaaggggtgatgaataacgtgctctataaccagtttaaagcgaacgccgatccgtctaaaaaatccgttttaacgattgattttgctttggagaaccgccattatttcaacacaaactcttatttttatgcgattggtggcgttggtagagacttgttagttaattctatgggggataaattggtgcgttttattggtaacaacactttgagttacaggaaaggcgatctttataacacttttgcgaacatcactacaggcggggaagtgaggttgtttaaaagcttttatgcgaacgctggggtgggggctaggtttggattggattacaaaatgatagatattataggaaatattggaatgcgtttagcgttttaa

SEQ ID NO: 475 - DNA, 8709 bp, Helicobacter pylori J99
atgaaacaatttaaaaagaaaccaaaaaagataaaacgatcgcatcaaaatcaaaaaacaatcttaaagcgtcctttatggcttatgcctttactgattggcgggtttgctagtggggtgtatgcggatggaacagacattttggggcttagttggggggaaaaaagccaaaaggtatgcgtgcatcgtccatggtatgctatatggagttgcgataaatgggaggaaaaaacacaacaatttacaggaaaccaactcatcacaaaaacttgggcagggggtaatgcggctaactactaccactctcaaaacaaccaagacatcacagccaatttaaaaaatgataacggcacttattttttaagcggtctgtataactacaccggaggggaatataatggggggaatttagacattgaattaggcagtaacgctacttttaatctaggtgcgagtagtgggaatagcttcacttcttggtatcctaatgggcatactgatgttacttttagcgctgggactatcaatgtgaataacagcgtagaagtgggcaatcgtgtgggatcgggagctggcacgcacaccggcacagccactttaaacttgaacgctaataaggttactatcaattccaatatcagcgcgtataaaacttcgcaagtgaatgtaggcaatgctaacagcgttattaccattaattcggtttctttaaatggggatacttgcagttctttagctagggtgggcgtaggggctaattgctccacttctgggcctagctattcttttaaagggacgactaacgctactaacacgacttttagcaattcaagcggcagtttcacttttgaagagaacgccacttttagcggggcgaaattaaatgggggggcattcactttcaataaaaagtttaacgctaccaataataccgcttttaatagcggtagttttacttttaaaggcacaagctcttttaatggtgcgaattttagtaacgcttcctatacttttaataatcaagccactttccaaaacagctcctttaatggggggacttttacttttaatgaccagaccaatcaaagcacccagcacccccaaattcaaaacagctcttttagcggcagtgctaccactcttaagggttttgcgacttttgagcaagcctttaacaattcaaaccaccaactaacgatacaaaacgcttcctttaataacgctactttcaacaataccggtaaaatcactatagaaaaagatgcgagctttaataacacttcgttcaacactcctgttgatacaaacaacatgactattagtggtggcgttactttaagcggtaaaaatgacttgaaaaatggtgcaacccttgattttgggagttctaaaatcactctcactcaagggacgactttcaacctcacaagtttaggcagtgagaagagcgtaacgattttaaattctagaggtgggatcacttacaatcatcttttaaaccatgcgatcaatagcttgacaaacgccctaaaaacgaacgaaagctcttcaaaaccgcaaagtttcgctcaaggtttgtgggatatgatcacttacaatggggttaccgggcagcttttgaatgaaaacgctgcaacatctaaacccactgactcttcgccctctaaatcctctacaaactctacgcaagtctatcaagtgggttacaaaataggggatactatctacaaactgcaagaaactttcagccacaattccattattattcaggctttagagagcgggacttacacgccaccccctgtcattaacggctccaaatttgacttatccgcttcaaattatatcaatgctgacatgccttggtataaccataaatattatattcctaaatcccaaaattttacagagagcgggacttattacttgccgagcgttcaaatatgggggagctacactaactcgtttaaacaaacctttagcgcaagtaatagcaatctggtgattgggtataacgcaacatggactgatcacaatgtttcttctagcgacacggtggcttttggggacacttcagggagcgctcttaatgggcattgcgggccttggccctattaccaatgcacaggcacgactaacggcacttatagcgcttatcatgtctatatcacagcgaatctgcgttctggcaatcgtataggcaccggtggggcagccaatctaatctttaatggggtagatagtatcaatatcgctaacgctaccatcacgcaacataacgccggggcttattcaagctctatgactttttccacgcaaaacatggacaattcgcagaatttgaatggcctaaattctaacggcaagcttttggtgtatggcacaactttcactaaccaagccaaagacgggaaattcattttcaatgcagggcaagcgacttttgaaaacaccaactttaatggagggagttaccaattcagcggcgatagcttgaatttttcaaataacaaccagttcaatagcggttcgtttgagattggcgcaaaaaatactatttttaataacgctaattttaacaacagcacttcttttaatttcaataattctagcgcgaccacttcgtttgtgggggatttcactaacgctaattcaaatttgcaaatcgctgggaacgctgtttttgggaactctactaatggctctcaaaataccgctaattttaataataccggctctgttaatattgcagggaatgcaacctttgataacgtggtatttaacagccctacgaacacgagcgtgaaagggaaagttactctcaataacatcactttaaaaaacttgaacgctcctttgtcttttggcgatgggacgattgtttttagcgctcattcggtgattaatattggtgaagctatcacaaatggcaaccctatcacccttgtaagctcttctaaagcaattgaatacaacgacgctttcagtaaaaatctatggcagctcatcaactaccaagggcatggggctagcagtgaaaagctcgtttctagtgcgggtaatggcgtctatgatgtggtgtattctttcaacaaccaaacctacaatttccaagaggttttttcacccaacagcatttctatccggcgtttgggcgttggcatggtgtttgattatgtggatatggaaaaatcggatcgtttgtattatcaaaacgctctcggttttatgacctacatgcctaatagctataacaataatttagggaatttaaacaacaccatttactattacgacaacagcattgacttttatgcgagcgggaaaactctattcactaaagcggaattttctcaaacgttcactgggcaaaacagcgcgatcgtttttggggctaaaaatatatggacgagcgtaagcgatgcgccgcaatctaatgtgatcattcgctttggggacaataagggagcagggagtaatgatgcgagtgggcattgctggaatttgcaatgcataggctttatcacagggcattatgaagcgcaaaagatttacatcaccggcagtattgaaagcgggaaccgcatttctagcggtgggggcgcgagccttaattttaacgggcttcaaggcattcttttaacgaacgcgactttgtataaccgcgccgctggcacgcaaagctcttctatgaattttgtttctaacagcgcgaacattcaggctcaaaactcctattttatagacgataccgcacaaaataaaggcaaccctaattttagtttcaacgctttgaatctggatttttctaacagctcttttagaggctatgtggggcaaacgcagtctgtttttaaattcaatgccgttaatgcgatcagtttcactaacagctctaatttaagctctggtttgtatcaaatgcaagctaaaagcgtgttgtttgacaattccaatttaagcgtttcagtggggacaagcagcattaaagccaatgcgatcaatctttctcaaaacgcctctatcaatgcgagcaaccattcaaccttagaacttcaaggcgatttgaatttgaacgacaccagctcgctcaacctcaaccaaagcgccattaatgtttctaacaacgccacgatcaacgattatgcgagcttgattgcgagtaatggctctcaccttaattttaacggggcggttaatttcaattcagcgaatattactacgagtttgagtagttcctctatcgtgtttaagggggcggtctctttacgagggcagtttaatttaagcaataattcttctttagattttcaaggctctagcgctatcacctctaacacggcgtttaatttctatgataacgctttttctcaaagccccatcactttccatcaagcccttgacattaaagtgcccttgagtttgggaggcaacctcttaaaccctaacaacagtagcgtgctgaatttaaaaaacagccagcttgtttttagcgatcaagggagcttgaatatcgctaacattgatttactaagcgatctgaatggtaataaaaatcgtgtgtataacatcattcaagcggacatgaatggtaattggtatgagcgtatcaacttctttggcatgcgcattaatgatgggatttatgacgctaaaaaccaaacttatagtttcactaaccctctcaataacgccctaaaaatcaccgagagctttaaaaataaccaactgagcgttacgctctctcaaatcccgggcattaaaaacacgctctataacattggctctgaaatctttaactaccaaaaggtttataacaacgctaatggcgtgtattcttatagcgatgacgcacaaggcgtgttttatctcacgagcagcgtgaaaggctattacaaccccaaccaatcctatcaagccagcggcagcaataacaccacgaaaaataacaatctaacctctgaatcttctgtcatttcgcaaacctataacgcgcaaggcaaccctatcagcgcgttacacgtctataacaagggctataatttcagtaatatcaaagcgttagggcaaatggcgctcaaactctaccctgaaatcaaaaagatattagggaatgatttttcgctttcaagtttgagcaatttaaaaggcgatgcgctaaaccagcttaccaagctcatcacgcctagcgattggaaaaacattaacgagttgattgataacgcaaacaattcggtcgtgcaaaatttcaataacggcactttgattataggagcgactaaaatagggcaaacagacaccaatagtgcggtggtttttgggggcttgggctatcaaaagccttgcgattacactgatattgtgtgccaaaaatttagaggcacttatttggggcagcttttggagtccatctcggctgatttgggctatattgacacgacttttaacgctaaagaaatttatcttaccggcactttagggagcgggaacgcatgggggactggggggagtgcgagcgtaacttttaacagccaaacttcgctcattctcaaccaagcgaatatcgtaagctcgcaaaccgatgggatttttagcatgctgggtcaagagggcatcaataaggttttcaatcaagccgggctcgctaatattttgggcgaagtggcaatgcaatccattaacaaagccgggggattagggaatttgatagtaaatacgctagggagtgatagcgtgattggggggtatttaacgcctgagcaaaaaaatcaaaccctaagccagcttttggggcagaataattttgataacctcatgaacgatagcggtttgaacacggcgattaaggatttgatcagacaaaaattaggcttttggaccgggctagtggggggattagccggactggggggcattgatttgcaaaaccctgaaaagcttataggcagcatgtccatcaatgatttattgagtaaaaaggggttgttcaatcagatcaccggctttatttccgctaacgatatagggcaagtcataagcgtgatgctgcaagatattgtcaagccgagcgacgctttaaaaaacgatgtagccgctttgggcaagcaaatgattggcgaatttttaggccaagacacgctcaattctttagaaagcttgctgcaaaaccagcagattaaaagcgttttagacaaagtcttagcggctaaaggattagggtctatttatgaacaaggtttgggggatttgatccctaatcttggtaaaaaggggattttcgctccctatggcttgagtcaagtgtggcaaaaaggggattttagtttcaacgcgcaaggcaatgtttttgtgcaaaattccactttctctaacgctaatggaggcacgctcagttttaacgcaggaaattcgctcatttttgccggaaacaaccacatcgctttcactaaccattctggaacgctcaatttgttgtctaatcaagtttctaacattaacgtcaccatgcttaacgctagcaacggccttaagattaacgccactaataacaatgtttccgtgtctcaaggcaatctgtttatcaacgctagctgcgtgcaacaaagcgatccaacgacagctagcgccacaaacccttgcaccaccgctcaaaataacgcttcttctagtaatgcgtcaaacaacgcgccaatcgccttaaataataacgatgaaagcttggtggttacggcgaatggtttcaatttttcaggcaatatttacgctaacggggtggttgatttttcaaaaattaaaggctctgcaaacgttaaaaacctgtatctttacaataacgctcaattccaagccaacaacctcacgatttccaaccaagcggtattagagaaaaacgctagctttgtaacgaataacttaaacattcaaggagcgtttaacaacaacgccacgcaaaaaatagaggtgcttcaaaatttagtgatcgcttcaaacgcttctttaagcaccgggatttatgggttagaagtagggggggcattgaataatttgggagcgatccattttaatttagaaaattctcaaacgcctgtaaatccgctcattcaagtaggggggatcattaatctcaacaccacccaaacgccttttatgaatgtcagcgtggctaatggcggaacttacactttattaaaaagcagccgttatattgattacaatatcaaccctaacagcttgcaatcgtatttgaagctctataccttaatcaatatcaacggaaaccacatagaggaaaaaaacggcgtattgacttatttgggccaacgggttttattacaagataaggggttattattgagtgtagcactacctaactcaaacaacgcctctcaaaacaacattttaagcctttctgtccttcacaaccagattaaaatgtcttatggtaataaagtgatggactttacccctcccaccttacaggattacattgtgggcattcaaggacaaagcgcactcaatcaaattgaagctgttggggggaataacgctatcaagtggctttcaacattgatgatggagactaaagaaaacccgctttttgcgccgatttatttagaaaaccactctttaaatgaaatcttaggcgtaacaaaagatcttcaaaacaccgcaagcttgatttctaaccctaattttagaaataacgctaccagccttttagaaatggcgagttacacccaacaaaccagccgtttgacaaaactctctgattttagggctagagagggagagtccaatttttcagagcgcttgttagagcttaaaaacaagcgttttagcgatcctaaccctagtgaggtttttgtcaaatactctcaactcagcaaacaccccaataacctttggattcaaggggtgggaggagcgagctttatttctgggggcaatggcacgctttatggcttgaatgtgggctatgaccgattggttaaaagcgtgatccttgggggttatgtggcttatggctatagcggttttaacgggaacatcatgcattctttggctaataatgtggatgtggggatgtatgcgagggcttttttgaaaagaaacgaattcactttgagcgcgaatgaaacttatggaggcaatgcgagtcatatcaattcttctaattccttgctctctgtgttgaaccaacgctacaactacaacacctggacaacgagcgtgaatgggaattacggctatgatttcatgttcaaacaaaaaagcgtggtgctaaaacctcaagtgggcttgagctatcatttcataggcttgagcgggatgaaaggtaaaatgcaaaatccagcttaccaacaattcgtcatgcattcaaacccttctaacgaatcggttttaacgctcaacatggggttagagagccgtaaatattttggtaaaaattcctattattttgtaacggcgaggttgggtagggatcttttgatcaaagctaaaggcgacaatgtggtgcgttttgtgggtgaaaacactttattgtaccgcaagggggaaatttttaacacttttgcgagcgtgatcacaggaggcgaaatgcatttgtggcgtttgatgtatgtgaatgcgggggtggggcttaaaatgggcttgcaataccaagatcttaatatcactgggaatgtgggcatgcgagtggcgttttag

SEQ ID NO: 476 - DNA, 7200 bp, Helicobacter pylori J99
atggcgtttaaaaaggccagattgatttccaggtttatttcaaaaggatctttcaaattgaataagatctcaaagaaatttttcacattgaatcaaatcttaaagcgtgaaaagcccttaaaacgccataaaaaaacaaaatctattgaaaagccctttaataaaaacaaatcttttttaaaagcttcggttttattgataggagcgctaggggggttatcccacctaagggctaacgaatgccgttattggtcatggtcgtcttggagttatcaagacaatattgaaagcggtcctaattcacccacgcacaactcttattgtctttttagtagcgctcaaggctctgggacttattatttaaacactcttaccacttatagcgctggtggggctagtttcacgcaaaaattcaatggtggcacgcttgatataggggggaatatccgctttggaggcacaggtattaatggaggtgatgtagggtatatcactggaacttataatgctcaaacgatgaattttaattctagccatatcacaaccggaaactcatacgctgatggcggtgggaccacgctcaattttaacgcgactaacaatatcactatcaatcaagcgagctttgataacagcgatgcagggacacaaaaatcttacatgaattttaaaggctctaatatcaagatcagtggctctagctttacagacgacaccaatggaggttttaatttcagcggtaataacaataatagcaccatctctttcaatcaaaccagcttcaatcaagggacttataattttagtaacagcgccactttaagcttcaataacagcaatttcaatcaagggacttatcactttaacagcgcccaatccacttttgaaaacagcaatttcaatcaaggcacttataattttaatgacaatactagctttaataacgacaccttcaatcaaggcacttataattttaatagcagcaaggtgagtttttcaggcgctaacactttaaattcaagttcgccttttgctagccttaaaggcagtgtgtcttttaattctggtgcgatttttaacctcaatcaaacccttaataataatcaaacctatgacattctcactacaaacggagcgatccagtatggggtttatcaaagctatttgtgggatctaatcaactataagggcgataaagccattagccatgttgaagtgagtaataacacttatgatgtaacctttgacattaacgggcaagatgaaaccttacaagaaacctttagcaaccaatctattattacccaatttttaggagacgatttacaacaacaagcccaacaaacctatcaagaggatgtagctaattcccagaacgctttgaataaggttgctagcgacaacacgatcgcaaataacgatacaagctacactcaaagcagtaaccccactatccttaaagacgctcaaggtttagaaaacaccaaccaacaaatccaacaagacgaaaaagccttagaaaaagatttagcccaaatcaagcaattagccaactccaccacaggctttaacgaacaagctttcactcaagctcaaaaacaagaacaacaagatgaacaagccttacagaacgatgaaaacgcttttaatacggaacaagagggattagaacaagcgatagctaacgctaaacatgccaaccccacaccaaatccgacaccaagccccacacccactcctataaaacacacagcgccaaacactccccctagtcaagtcccgcccacaccccctagtcaaaatttacctaaaacaaatgtgtggaatggggtttattggcttcaaaacaaaacttactcaaacaaaggcatttattatattgatcccaatctttcaggacagagcggtcaaagcggcaacacgctcagcacctatacagctaatttgttagggagaagttttggcgtcaatgctaacaatggcactttgatcatagggaataatacagagagtgtgaatgataacgggttgatttggatagggcatggaggctttggctatattacgggaacttttagtgcggctaacatttacttgaccaataattttaaaaccggtgaaggcgtttcaaattcagatggtgggggagcgaacattacctttaaagcaagcgataatatcactatggatggcttgaattacaataacgctgaaaccgttactaaaatgattcaaacaggggccagtcagcattcctataccacttttgacgctaccaataatatcagtgtaactgattctgattttagcgatatgacttgggggaaattcagttttagcgctaagaatatttcgttttctaacgcttcgttcagcggctttacaaaccctggaggatcaagcactatcagcacgaatgcttctaattctttaagctttacagattctcgcttgaatggtggagcaatctataatttacaggctaatagccttattttcaataacacgcaagcggtttttaatgtcttgtattctagggggacaagcaattttaacgccaccacacagcttttaggcaacacgagttttacgcttagctctcaaagtttgctaaactttaatggcgatacaaccttgcaaaacaacgctaatatcacgcttggcaataaaagtcaagccgcttttaaaaattctttaacgcttgataacaattctaatttaagcttagacaatcaaagcgttttgaacgcgaatggcacgagtgcttttaacaatcaagcgagtctcaacatttataatgggagtcaagcggcctttagcagtctcttttttaatggcggaacactcagtcttaacgcgaatagcaagctcaacgcttctagcgctagtttttcaaacaacaccactattaatttagacgatagcgttttgaatgcgaataacacaagctctttaaacgctaatatcaattttcaaggcgcaagccaggctgattttggaggcaacacgactattgatacagcaagctttaattttgacagcgcaagttcattgaattttaataaccttacggctaatggggcgttaaattttaatggttatgcgccctctttaactaaggctttaatgaatgtcagcgggcagtttgttttagggaataatggggatattaatttatctgacatcaatatctttgacaacatcacaaaatctgtaacttacaacatcttaaacgctcaaaaagggattactggcattagtggggctaatggctatgaaaaaatccttttttatggcatgaaaatccaaaacgctacctatagcgataataacaacatccaaacttggtcgtttataaaccctctcaattcttctcaaatcattcaagagagcattaaaaatggggatctaaccatagaagttttaaataaccctaactcggcttccaacactatttttaatatcgctcctgagctttataattaccaagattctaagcaaaatcctaccggctatagctatgattatagcgacaatcaagcaggcacttattacttgacaagcaacattaaaggtcttttcacccctaaaggctctcaaacgcctcaaaccccaggcacttatagcccatttaaccagcctttgaatagtttgaatatctacaataagggtttttctagcgagaatttaaaaacgcttttagggatcctttctcaaaattccgccaccttaaaagaaatgattgaatccaaccaactagacaatatcactaacattaatgaagtgttgcaactcttagataagattaaaatcacccaagcgcaaaagcaagcgctcctagaaacgatcaaccatttgactgacaacatcaatcaaacctttaataacgggaatctcgttataggcgctacccaagataatgttacaaactctactagctctatatggtttgggggcaatggctatagcagcccttgcgcgctagatagcgccacttgttcttcttttagaaacacttacttggggcaattattaggctcaacttccccttatttaggctacattaacgctgattttaaagctaaaagcatttatattaccgggacaattggaagtagtaacgcttttgaaagcggagggagcgcggatgtaacctttcaaagcgctaataacttagtgttgaataaagctaacatagaagctcaagccacagacaatatctttaatcttttgggtcaagaagggattgataaaatctttaatcaggggaatttagcgaatgttcttagtcaaatggctatggaaaaaatcaagcaagccggcggtttagggaactttatagaaaacgctctaagccctttgagtaaggaattacccgctagcttgcaagatgaaaccttaggccaacttataggtcaaaataacttagatgatttattgaataatagtggagtcatgaatgaaatccaaaacattatcagtcaaaaactaagcatttttggcaattttgttaccccatccatcatagaaaactaccttgctaagcagtctttaaaaagcatgctagacgataaagggcttttgaattttatcggtgggtatatagacgcttctgaattaagctctattttaggcgtgattttaaaggatattactaacccccctacaagcctgcaaaaagacattggtgtggtagcgaacgacttgttgaacgagtttttaggacaagatgttgtcaaaaagctagaaagtcaaggcttggtgagtaatatcatcaataatgttatttctcaaggcgggttgagcggcgtttataatcaaggtttagggagcgtgttgccgccctctttacaaaacgcgctcaaagaaaacgatttaggcactcttttatcgcctagaggcttgcatgatttttggcaaaaagggtattttaactttttaagcaatggctatgtttttgtcaataacagctcttttagtaacgctactgggggtagtttgaattttgtcgccaacaagtctattatctttaatggcgataatacgattgactttagcaagtatcaaggcgcattgatttttgcttctaatggtgtttctaatatcaatatcaccaccctaaacgccactaatggcttaagccttaatgcgggtttgaataatgtgagcgttcaaaaaggagaaatttgtatcaatttagccaattgccctacaaccaaaaacagctctcctgcaaactctagcgtaacccccactaatgagtctttaagcgtgcacgctaataatttcactttcttaggcacaatcatctctaatggggctattgatttgtctcaagtaacaaataatagcgttataggcacgctcaatctcaatgaaaatgcgaccttgcaagctaataatttaacgatcaccaacgcttttaacaacgcctctaactctacggctaatattgatggtaatttcaccttaaaccaacaagcgactttaagcactaacgctagtggtttgaatgtcatggggaattttaatagctatggcgatttggtgtttaacctcagtcattcagttagtcatgctattatcaatactcaaggcacagcgacgatcatggccaataataaccctttgatccaattcaacgcttcttcaaaagaagtgggtacttacacgctgattgatagcgctaaagccatttattacgggtataacaaccaaatcacaggaggcagtagcctggataattaccttaagctttatgcgctcattgatattaatggcaagcacatggtgatgactgacaacggcttaacctataacgggcaagccgtgagcgttaaagatggcggtttagttgtaggctttaaggactctcaaaatcaatacatttacacttccattctttataataaagtgaaaatcgctgtttctaatgatcctatcaataacccacaagcccccactttaaaacaatatatcgctcaaattcagggcgttcaaagcgtggatagcatcgatcaagctgggggaaatcaagcgattaattggctcaataaaatctttgaaactaaaggaagccctttattcgctccctattatctagagagccactccacaaaagatttaaccacgatcgctggagatattgctaacactttagaagtcatcgctaaccctaattttaaaaatgacgccactaatattttacagatcaacacctacacgcagcaaatgagtcgtttagccaagctctctgacacttcaactttcgcccgttctgatttcttagaacgcttagaagcccttaaaaacaagcgattcgctgatgcgatccctaacgctatggatgtgattttaaaatactctcaaaggaatagagttaaaaataatgtgtgggcgacaggagttggaggggctagtttcattagtggaggtactggaactttatatggtatcaatgtagggtatgataggtttattaagggcgtgattgtgggaggttatgccgcttatgggtatagcgggttccatgcaaacatcactcaatcaggctctagcaatgtcaatgtgggcgtttatagccgagcgtttatcaaaagaagcgagctaaccatgagcttgaatgagacttggggatacaataaaactttcatcaactcctatgaccccctactctcaatcatcaatcagtcttacagatacgacacttggacgactgacgctaaaatcaattatggctatgatttcatgtttaaagataaaagcgttatttttaaaccccaagtaggcttaagctattattacattggtttgtctggtttaaggggcattatggatgatcctatttacaaccaattcagagccaatgctgaccctaataaaaaatccgttctaacgatcaattttgccctagaaagtcggcattatttcaataaaaactcttattattttgtgattgcggatgtgggcagagacttattcattaattctatgggggataaaatggtgcgtttcatcggtaataacaccctaagctatagagatggtggcagatacaacacttttgctagcattatcacaggcggggagataagattgttcaaaaccttttatgtgaatgcgggcataggggctaggtttgggcttgattataaagatattaatattaccggaaatattggtatgcgctatgctttttaa

SEQ ID NO: 477 - DNA, 3867 bp, Helicobacter pylori J99
atggaaatacaacaaacacaccgcaaaatcaatcgccctttagtttctctcgttttagcaggagcgttgattagcgccataccgcaagagagtcatgccgcctttttcacgaccgtgatcattccagccattgttgggggtatcgccacaggcactgctgtaggaacggtctcagggcttcttagttggggactcaaacaagccgaagaagcgaataaaaccccagataaacccgataaagtttggcgcattcaagcaggaaaaggctttaatgaatttcctaacaaggaatacgacttatacaaatcccttttatccagtaagattgatggaggttgggactgggggaacgccgctaggcattattgggtcaaaggcgggcaatggaacaagcttgaagtggatatgaaagacgctgtagggacttataaactatcagggcttagaaactttactggtggggatttagacgtgaatatgcaaaaagccactttgcgtttgggccaattcaatggcaattctttcacaagctataaggatagcgctgatcgcaccacgagagtgaatttcaacgctaaaaatatttcaattgataattttgtagaaatcaataatcgtgtgggttctggagccgggagaaaagccagctctacggttttgactttgcaagcttcagaagggatcactagcagtaaaaatgcggaaatttctctttatgatggcgccacgctcaatttggcttcaaacagcgttaaattaaatggtaatgtgtggatgggccgtttgcaatacgtgggagcgtatttagccccttcatacagcacgatcaacacttcaaaagttcaaggggaagtggattttaaccatctcactgtgggggatcaaaacgccgctcaagcgggcattatcgctagcaataagactcatattggcacactggatttgtggcaaagcgccgggttaaatatcattgcccctccagaaggtggctacaaggataaacctaatagtaccacttctcaaagtggcactaaaaacgacaagaaagagatcagtcaaaataacaatagcaacacagaggtcattaacccacccaataacacgcaaaaaacagaaactgaacccacgcaagtcattgatgggccttttgctggcggcaaagacacggttgtcaatattttccacttaaacactaaagccgatggcacgattaaagtgggagggtttaaagcttctcttaccacgaatgcggctcatttgaatatcggcaaaggcggtgtcaatctgtccaatcaagcgagcgggcgcacccttttagtggaaaatctaaccgggaatatcaccgttgatgggcctttaagagtgaataatcaagtgggtggctatgctttggcaggatcaagcgcgaattttgagtttaaggctggtgtggatactaaaaacggcacagccactttcaataacgatattagtttgggaagatttgtgaatttaaaggtggatgctcatacagctaattttaaaggtattgatacgggtaatggtggtttcaacaccttagattttagtggtgttacagacaaagtcaatatcaacaagctcatcacagcttccactaatgtggccgttaaaaacttcaacattaatgaattgattgttaaaaccaatgggataagtgtgggggaatacactcattttagcgaagatataggcagtcaatcgcgtatcaataccgtgcgtttggaaactggcactaggtcaatcttttctgggggtgtcaaatttaaaagcggtgaaaaactagttatcaatgatttttactatagcccttggaattattttgacgctaggaatgttaaaaatgttgaaatcaccagaaaattcgcttcttcaaccccagaaaacccttggggcacatcaaagctcatgtttaataatctaaccttgggtcaaaatgcggtcatggactatagtcaattttcaaatttaaccattcagggggattttatcaacaatcaaggcactatcaactatctggtccgaggcgggaaagtggcaaccttaaatgtaggcaatgcagcagctatgatgtttaataatgatatagacagcgcgaccggattttacaaaccgctcatcaagattaacagcgctcaagatctcattaaaaatacagagcatgttttattgaaagcgaaaatcattggttatggtaatgtttctacaggtaccaatggcattagtaatgttaatctagaagagcaattcaaagagcgcctagccctttataacaataataaccgcatggatacttgtgtggtgcgaaatactgatgacattaaagcatgcggtatggctatcggcaatcaaagcatggtgaacaaccctgacaattacaagtatcttatcggtaaggcatggagaaatataggcatcagtaaaacggctaacggctctaaaatttcggtgtattatttaggcaattctacgcctactgagaatggtggcaataccaccaacttacccacaaacaccactaataatgcgcattctgctaactacgctctcgtgaagaacgctcctttcgctcacagcgccactcctaatttagtcgctatcaatcagcatgattttggcactattgagagcgtgtttgaattggctaaccgctctaaagatattgacacgctctatactcattcaggcgcgcaaggcagggatctcttgcaaactttattgattgatagccatgatgcgggttatgccagacaaatgattgataacacaagcaccggtgaaatcaccaagcaattgaatgcggccactgacgctttaaacaacgtagccagtttagagcataaacaaagcggcttacaaaccttgagcttgagtaatgcgatgattttaaattctcgtttagtcaatctctctaggaagcacaccaaccatattaactcgttcgctcaacgcttacaagctttaaaaggccaagaattcgcttctttagagagcgcggcagaagtgttgtatcaatttgcccctaaatatgaaaaacctaccaatgtttgggctaacgctattgggggagcgagcttgaatagcggctctaacgcttcattgtatggcacaagcgccggcgtagacgctttccttaacgggaatgtggaagccattgtgggcggttttggaagctatggttatagctcctttagcaatcaagcgaactctcttaactctggggccaataacgctaattttggcgtgtatagccgtttttttgccaaccagcatgaatttgactttgaagctcaaggggcgctagggagcgatcaatcaagcttgaatttcaaaagcactctattacaagatttgaatcaaagctataattacttagcctatagcgccacagcaagagcgagttatggttatgacttcgcgttttttaggaacgctttagtgttaaaaccaagcgtgggcgtgagctataaccatttaggttcaaccaactttaaaagcaatagccaatcacaagtggctttaaaaaatggcgcgagcagtcagcatttattcaacgctaacgctaacgtggaagcgcgttattattatggggacacttcatacttttatttgcatgcgggagttttacaagagttcgctcactttggatcgaatgatgtggcgtctttaaacacctttaaaatcaatgccgctcgcagtcctttaagcacctatgcaagagcgatgatgggtggggaattgcaattggctaaagaagtgtttttgaatttgggcgtggtttatttgcacaatttgatttccaacgcaagccatttcgcttccaatttaggaatgaggtatagtttctaa

SEQ ID NO: 478 - DNA, 2235 bp, Helicobacter pylori J99
atgaaaaaacacatcctttcattaactttaggatcgcttttagtttccactttgagcgctgaagacgacggcttttacacaagcgtaggctatcagatcggtgaagccgctcaaatggtaacaaacaccaaaggcatccaagatctttcagatcgttatgaaagtttgaacaaccttttgaatagatacagcaccctaaacacccttatcaaattgtccgctgacccgagcgcgattaatgcggtgcgggaaaatctgggcgcgagcgcgaagaatttgatcggcgataaagccaattccccggcgtatcaagccgtgcttttagcgatcaacgcggcggtagggttttggaatgtcgtaggctacgtgacgcaatgcgggggtaacgccaatggtcaaaaaagcatctcttcaaagaccatcttcaacaacgagccagggtatcgatccacttccatcacttgttctttgaacgggcattctcctggatactacggccctatgagcattgaaaatttcaaaaagcttaacgaagcctaccagatcctccaaacggctttaaaacgaggcttgcccgcgctcaaagaaaacaacgggaaagtcaatgtaacctatacttacacatgctcaggggacgggaataataactgctcgtcacaagtcacaggtgtaaataatcaaaaagacggaaccaagactaaaatccaaaccatagacggcaaaagcgtaaccaccacgatcagttcaaaagtggttgatagtcgtgcagatggtaatacaacaggggtgtcctacaccgaaatcaccaacaaattagaaggtgtgcctgatagcgctcaagcgctcttagcgcaagcgagtacgctcattaacaccatcaacaacgcatgcccgtatttccatgctagtaatagtagtgaggctaacgccccaaaattctctactactactgggaaaatatgcggcgctttttcagaagaaatcagcgcgatccaaaagatgatcacggacgcgcaagagctggtcaatcaaacgagcgtcattaacgagcatgaacaaacaactccggtaggcaataacaatggcaagcctttcaaccctttcacggacgctagttttgcgcaaggcatgctcgctaacgctagtgcacaagccaagatgctcaatctagccgaacaagtggggcaagccattaaccctgagaggcttagcgggacttttcaaaattttgttaaaggctttttagccacatgcaacaacccatcaaccgctggtactggtggcacgcaaggttcagctccaggcacagttaccactcaaactttcgcttccggttgcgcctatgtaggacaaacgataacaaatcttaaaaacagcatcgcccattttggcactcaagagcagcagatacagcaagccgaaaacatcgctgacactctggtgaatttcaaatctagatacagcgaattgggcaacacttataacagcatcaccactgcgctctctaatatccctaacgcgcaaagcttgcaaaatgcggtgagtaaaaagaataacccctatagcccgcaaggcatagacaccaattactacctcaatcaaaactcttacaaccaaatccaaaccatcaaccaagaactcgggcgtaacccctttaggaaagtggggattgttagttctcaaaccaataatggcgcgatgaatgggatcggtattcaggtgggttacaaacaattctttggccaaaaaagaaaatggggcgctaggtattacggcttttttgattacaaccatgcgttcattaaatccagcttcttcaactcggcttctgacgtgtggacttatggctttggagcggacgctctttataatttcatcaacgataaagccaccaatttcttaggcaaaaacaacaagctttctgtggggctttttgggggtattgcattagccgggacttcatggcttaattctgagtatgtgaatttagccaccatgaataacgtctataacgctaaaatgaacgtggcgaatttccaattcttattcaacatgggagtgaggatgaatttagccaggcctaagaaaaaagacagcgatcatgcggctcagcatgggattgagttagggcttaaaatccccaccatcaacacgaactactactcctttatgggggctgaactcaaataccgaaggctctatagcgtgtatttgaattacgtgttcgcttattaa

SEQ ID NO: 479 - DNA, 3714 bp, Helicobacter pylori J99
atgataaaaaaagctaaaaaattcataccattctttttaattggctccctcttagctgaagacaatggctggtatatgtctgtaggctatcaaatcggtggcacgcagcaattcatcaataacaaacaacttttagaaaatcaaaatatcatcaatagcatcactcaaagcgcgatcaacattgcagggcctactaccggccttatcactttaagctctcaaaccgtcattgacgctttaggctatggcgtgagtaacactgttggcaaccaattagagggcatttctaacatcttgaatcaaattggcaaaagaaaagacttttattctagccgtcaaatctctagcatttcccagcaaatcatagggcttaaaggaagctctgatcccttaaaagcccattcttcacaaatcacagccaaactcctttccaacacccaaagcgcgtttgatcagggcatcgctctaagctctaatatcattagtgcagtcaatagcctaaaccctagcaacaactcccaagaagtcaaagcccagctccaaaacaccgcgcaatccatggcggaattattgcaacaaattgaacacagcatcactaaaaccactagcaccacttacgcacaatccttactctccaatctgaccgatgcggtgaatgcatctagcaataataccacttatgtgagcgctcttgttaacgctttaaacactttaggggtgggggttttccccaccacaacctcaacgcatgtggtgctaaacccaccgggacaagtcgtattctatccaactaattcccttttaggctctacttcttcaaacagcaataaccaacaacaatacaacaacacccttttaatgaacaccttacaaggggaattaagcactaacaatcaaaataaccccaatggttgcgccaatcaaatccagtgtttagagcaattcatccaaaatttaacccctttagccgcaacccccacttcaactaaccaggccaaccagcaagtccaagccatcgctcaaaaacttcaaagcgttgctatcaacgctttagacaacaatgcgatcaacaacaccacctataatttaaacaacttgcacaacgctttgaatttccaagcctatcaaagcacgatagaacaatacaataacgctttaaagcaaatttcgtggattagttttagcgagcctaaaaacttgctcaaaaacacttccaataactaccaaatcggcacggttaccaacgatcaagggcaaaatatcagcgcctatgattgcacaagcgctaccggaagcctttctagcgatgcttctagtgggatttcatgctcagccacaagctccacaaataacacaaatagttttgacaattctttagtcgctacctccaaagtccaaaccatcaacggcaaagagcagatcggcgtgaattcttttaatcttgtctctcaagtgtggagcgtttataactctttaaaaacttcagaagaaaatttgcaaaaaaacgccaaaatattatgcaacaatggatcgcaatctgggacaagcccatgcaatagctcttcagggggtttgagcatcagcgggaacgcccaattgcaaaatattttaagccctactaatgggactaccactaatactcaagctaaaagcaacgcttccaaactaaaagcgatggtaatggtgaataatgaagaagaagccaaaacgaccaatttcaatcaaagcagtgggccaaccacacaatcttctaacagcacggtgatgggagctttaaacaccgtattgcaaaatgtcagcaatttccaacaaagcattcaaagcgcttttcaaaaccaagaaaataatatccaagcttgggcgaacgcactttataacactagtaaccctaatgggaatcaatcgcaaaatttaaccactaacaataaccaagatttacgcatccaattaagggcgaatttttaccagctcatcaataccattaaccagcaagtgcctacagacatgaacgctttaattaatcaaagccaacaaacccagcaaacaagcggatcagcaagcaccacgaacaacgcatgcgcgagcggaatggggagtagtggcaactggtgctaccagcagtggtccgattctaaggcttattacagcgggttgcaaagcgctttagggtatcaaacacaagcgacaactcaaaatgggagcagtggtgggagcaatatcacctacaatgtccaacaaatcacgctcactagcggtggtttgctcaatcaaattatcacaaaccttaagagcgttaatgggggcagtaatgggggaagcagtgggaatggcactagtcaaatcaacacagcctaccaaatgctcacagacgctagcgatgggaaattagggacttataatagtagcaatagtagcaatagtagcaatagtggcaataataacggctatacgccatgcaatagcaccaacgggagcaatgggacgagtgggagcaattgttatgaacccaacaaacaacaaaacgccaccaccgcaaccaccacgaccgacagcaatttacaaaaagtctataatgacgcccaaaaaatagccaatattatcgccagctctgggaacaataaaggcgttgaaaacggcttaaaacaattctttgaagcgttaaaaagtaatagcagcagtcttagtaatttatgtggtaatggtagtagcggtagtagctctacttgctccggtgggcttatcaaccttttaggggcaatccccacaaacggagtgagcgatacgaataatttaattaatctgctcactgaattcattaaaaccgccgggtttatccaaaataaggatagtaatgtatctactagtcttacaagcgcttttcaagccattacgagcgctatttctcaagggtttcaagccttgcaaaacgatattagccctaatgcgattttgaccttgctccaagaaatcacttctaacaccaccaccattcagtcattctcgcaaaccttacggcagcttttaggggataaaaccttctttatggtgcaacaaaagctcattgatgcgatgattaacgccagaaatcaggttcaaaacgcgcaaaatcaagccaataactacggctctcaacccgttttaagccagtatgcggccgctaaaagcacccaacacggcatgagcaatggcttaggggttggcataggctataaatacttctttggtaaggctaggaaattaggccttaggcattattttttctttgattacggctttagtgaaataggcctagccaatcaaagcgtgaaagcgaatatctttgcttatggggtaggcacggattttttatggaatctattcaggaggacttacaacactaaagcgttgaattttgggctatttgccggggtccaactgggcggtgcaacttggcttagttccttaaggcaacaaatcattgacaactgggggaacgctaatgacatccattcaacgaattttcaagtggcgctgaattttggggtgcgcaccaatttcgcggagtttaagcgttttgctaagaaattccacaatcaaggggtcatcagccaaaagagcgtggaatttgggatcaaggtgcctctcatcaatcaagcgtatttgaatagtgctggggctgatgtgagctacaggaggctttatactttctatatcaattacatcatggggttttaa

SEQ ID NO: 480 - DNA, 1584 bp, Helicobacter pylori J99
atgaaacaaaatttaaagccattcaaaatgattaaggaaaatttaatgacacaatctcaaaaagtaagattcttagcccctttgagcctagcgttaagcttgagcttcaatccagtgggcgctgaagaagatgggggctttatgacctttgggtatgaattaggtcaggtggtccagcaagtgaaaaacccgggtaaaatcaaagccgaagaattagcgggcctgttaaactctaccacgacaaacaacaccaatatcaatattgcaggcacaggagggaatgtcgccgggactttgggcaacctttttatgaaccaattgggcaatttgattgatttgtatcctactttgaaaactaataatcttcaccaatgcggtagcactaatagcggtaatggcgctactgctgccgctgctactaacaatagcccttgtttccaaggtaacctggctctttataacgaaatggttgactctatcaaaactttgagtcaaaacatcagcaagaacatctttcaaggcgacaacaacaccacgagcgctaatctctccaaccagctcagtgagttgaacaccgctagcgtttatttgacttacatgaactcgttcttaaacgccaacaaccaagcgggtgggatttttcaaaacaacaccaatcaagcttacgagaatggtgttaccgctcaacaaatcgcttatgtcctaaagcaagcttcaatcactatggggccaagcggtgatagtggggctgcgggagcgtttttagacgccgctttagcccaacatgttttcaactcggctaacgctgggaacgatttgagcgctaaggaattcactagcttggtgcaaaacatcgtcaataattctcaaaacgctttaacgctagccaacaacgctaacatcagcaattcaacaggctatcaagtgagctatggtgggaatattgatcaagcgcgctctacccaactgttaaacaacaccacaaacactttggctaaagttaccgctctaaacaacgagcttaaagctaacccatggcttgggaatttcgctgctggtaacagctctcaagtgaatgcgtttaacgggtttatcactaaaatcggttataagcaattcttcggggaaaacaagaatgtgggcttacgctactacgggttcttcagctataacggcgcgggcgtgggtaatggccccacttacaatcaagtcaatctgctcacttatggggtggggactgatgtgctttacaatgtgtttagccgctcttttggcagtaggagtcttaatgcgggcttctttggggggatccaactcgcaggggacacttacatcagcacgctaagaaacagccctcagcttgcgagcagacctacagcgacaaaattccaattcttgtttgatgtgggcttacgcatgaactttggtatcttgaaaaaagacctaaaaagccataaccagcattctatagaaatcggtgtgcaaatccctacgatttacaacacttactataaagctggtggcgctgaagtgaaatacttccgcccttatagcgtgtattgggtctatggctacgccttctaa

SEQ ID NO: 481 - DNA, 2112 bp, Helicobacter pylori J99
atgaaaaaaacccttttactctctctctctctctcgtttgggctccacgctgaagacgacggcttttacgcaagcgcgggaattcggatcggtgaagccgctcaaatggtgaaaaacaccaaaggcattcaacagctttcagagaattatgaaaagttgaacaatcttttaaataattacaacaccctaaacactcttgtaaagctgtcctccgatccgagtgctgtcaacgacgcaagggataatctaggctcaagcactaggaatttgctagatgtcaaagccaattcccccgcctatcaagcggtgcttttagcattgaacgctgcagtgggcttgtggcaagttacaagctatgcctttaccgcttgtggtcctggtagcaatgagaacgcgaatggaggtatccaaacctttaataatgtgccaggacaaaacacgacgaccatcacttgtaattcgtattatgagccaggacatggcgggccaatatccactaaaaattatgcgatcatcaacaaggcttatcaaatcattcaaaaggctttgacagccaatggagaagggatcccagttttaagcaacaccactacaaaacttgatttcactatcaatggagacaaaagaacgggtggcgaaccaaataaaaaattagtatacccatggagtcatgggaaagctatttcaacctcgtggaatgcaaccataacagcaccaacaacagaaaatatcaatacaaccaatagcgctcaagagcttttaaaacaagcgagcatcattatcactaccctgaatagtgcatgcccaaacttccaaaatggtggtagcggttattgggcagggataagtggcaatgggacaatgtgtgggatgtttaagaatgaaatcagcgctatccaaggcatgatcgctaacgcgcaagaagctgtcgcgcaagccaaaatcgttagtgaaaacacgcaaaatcaaaacagcctagacgctggaaaaccattcaacccctacacagacgctagttttgctgaaagcatgctcaaaaacgcgcaagcccaagcggagattttaaaccaagccgaacaagtggtgaaaaactttgaaaaaatccctacagcctttgtaaatgactctttaggggtgtgttatgaagtgcaaggaggtgagcgtcgtggcaccaatccgggtcagacgacttctaacacttggggggcaggctgtgcgtatgtaggacaaacgataacaaatcttaaaaacagcatcgcccattttggcactcaagagcagcagatacagcaagccgaaaacatcgctgacactctggtgaatttcaaatctagatacagcgaattgggcaacacttataacagcatcaccactgcgctctctaatatccctaacgcgcaaagcttgcaaaatgcggtgagtaaaaagaataacccctatagcccgcaaggcatagacaccaattactacctcaatcaaaactcttacaaccaaatccaaaccatcaaccaagaactcgggcgtaacccctttaggaaagtggggattgttagttctcaaaccaataatggcgcgatgaatgggatcggtattcaggtgggttacaaacaattctttggccaaaaaagaaaatggggcgctaggtattacggcttttttgattacaaccatgcgttcattaaatccagcttcttcaactcggcttctgacgtgtggacttatggctttggagcggacgctctttataatttcatcaacgataaagccaccaatttcttaggcaaaaacaacaagctttctgtggggctttttgggggtattgcattagccgggacttcatggcttaattctgagtatgtgaatttagccaccatgaataacgtctataacgctaaaatgaacgtggcgaatttccaattcttattcaacatgggagtgaggatgaatttagccaggcctaagaaaaaagacagcgatcatgcggctcagcatgggattgagttagggcttaaaatccccaccatcaacacgaactactactcctttatgggggctgaactcaaataccgaaggctctatagcgtgtatttgaattacgtgttcgcttactaa

SEQ ID NO: 482 - DNA, 1563 bp, Helicobacter pylori J99
atgataaagaagaatagaacgctgtttcttagtctagccctttgcgctagcataagttatgccgaagatgatggagggtttttcaccgtcggttatcagcttgggcaggtcatgcaagatgtccaaaacccaggcggcgctaaaagcgacgaactcgccagagagcttaacgctgatgtaacgaacaacattttaaacaacaacaccggaggcaatgtcgcaggggcgttgagtaacgctttctcccaatacctttattcgcttttaggggcgtatcccacgaaactcaatggtaacgacgtgtctgcgaacgctcttttaagtggtgcggtaggcagtgggacttgcgcggctgcagggacggctggtggcacaactcttaacactcaaagcgcttgcaccgctgcgggctattactggctccctagcttgactgataggattttaagcacgatcggcagccagactaactacggcacgaacaccaatttccccaacatgcaacaacagctcacctacttgaatgcggggaatgtgttttttaatgcgatgaataaggctttagagaagaatgggactgctactgctaatagcactagtagcactagcggtgcgactggttcagatggtcaaacttactctcaacaagctattcaataccttcaaggccaacaaaatatcttaaataacgcagcgaacttgctcaagcaagatgaattgctcctagaagctttcaactctgccgtagctgctaacattgggaataaggaattcaattcagccgcttttacaggtttggtgcaaggcattattgatcaatctcaattggtttataacgagctcactaaaaacaccattagcgggagcgcggttaataacgctgggataaactccaaccaagctaacgctgtgcaagggcgtgctagtcagctccctaacgctctttataacgtgcaagtaactttggataaaatcaacgcgctcaacaatcaggtgagaagcatgccttacttgccccaattcagagccgggaacagccgtgcaacgaatattttaaacgggttttacactaaagtgggctataagcaattcttcgggaagaaaaggaatatcggtttgcgctattatggtttcttttcttataacggagcgagcgtgggctttagatccactcaaaataatgtagggttatacacttatggggtggggactgatgtgttgtataacatctttagccgctcctatcaaaaccgctctgtggatatgggcttttttagcggtatccaattagccggtgagaccttccaatccacgctcagagatgaccccaatgtgaaattgcatgggaaaatcaataacacgcacttccagttcctctttgacttcggtatgagaatgaacttcggtaagttggacgggaaatccaaccgccacaaccagcacacggtggaatttggcgtagtagtgcctacgatttataacacttattacaaatcagcagggactaccgtgaagtatttccgtccttatagcgtttattggtcttatgggtattcattctaa

SEQ ID NO: 483 - DNA, 2073 bp, Helicobacter pylori J99
atgaagaaaaaatttctgtcattaaccttaggttcgcttttagtttccgctttaagcgctgaagacaacggcttttttgtgagcgccggctatcaaatcggtgaatccgctcaaatggtgaaaaacaccaaaggcattcaagatctttcagacagctatgaaagattgaacaaccttttaacgaattatagcgtcctaaacgctctcatcaggcagtccgccgaccccaacgccatcaataacgcaaggggcaatttgaacgcgagcgcgaagaatttgatcaatgataaaaagaattccccggcgtatcaagccgtgcttttagccttgaatgcggcagcggggttgtggcaagtcatgagctatgcgatcagcccttgtggtcccggtaaagacacaagcaaaaatgggggcgttcaaactttccacaacacgccttcaaatcaatggggaggcactaccattacttgtggcactactggttatgaaccaggaccatacagcattttatccactgaaaattacgcgaaaatcaataaagcttatcaaatcatccaaaaggcttttgggagcagcggaaaagatattcctgccttaagcgacaccaacacagaactcaaattcacaatcaataaaaataatggaaacacgaatacgaataataatggagaagaaattgttacaaaaaataacgctcaagttcttttagaacaggctagcaccattataactacccttaatagcgcatgcccatggatcaacaatggtggtgcaggtggtgcgagtagtggtagtttatgggaaggaatatatttgaaaggcgatgggagcgcttgcgggatttttaaaaatgaaatcagcgcgattcaagacatgatcaaaaacgctgcaatagccgtagagcaatccaagatcgttgctgcaaacgcgcaaaaccagcgcaacctagacaccgggaagacattcaacccctataaagacgccaacttcgcccaaagcatgttcgctaacgccaaagcgcaagcggagattttaaaccgcgcccaagcagtggtgaaagactttgaaagaatccctgcagagttcgtaaaagactctttaggggtgtgccatgaagtgcaaaacggccatctccgtggcacgccatccggcacggtaactgataacacttggggagccggttgcgcgtatgtgggagagaccgtaacgaatctaaaagacagcatcgctcattttggcgaccaagccgagcgaatccataacgcgcgcaacctcgcctacactttagcgaacttcagcagtcagtatcaaaaactaggcgaacactatgacagcatcacagcggccatttcaagcttgcctgatgcgcaatctttacaaaatgtggtgagcaaaaagactaaccctaatagcccacaaggcatacaggataactactatattgactccaatatccattctcaagtgcaatctaggagtcaagaactcggcagtaaccctttcaggcgtgctggcttaatcgccgcttctaccaccaataacggcgcgatgaacgggataggctttcaagtgggctataagcaattctttgggaaaaacaaacgatggggcgcaaggtattacggctttgtggattacaaccacacctataacaaatcccaatttttcaacgcctcttctgatgtctggacctatggcgtggggagcgatttgttagtgaatttcatcaacgataaagccactaaacacaataagatttcttttggcgcgtttggcggtatcgccttagccgggacttcatggcttaattctcagtatgtgaatttagcgaacgtgaataattattataaggccaaaatcaacacggcgaatttccaattcttattcaatctgggtttgagaatgaacctcgctaggaaaaagcatagagcgaccgataacgcggcccaacatggcattgaactaggcacaaagatccccacgatcaacacgaattactattctttgctaggcactaccttgcaatacagaaggctttatagcgtgtatctcaactatgtgttcgcttactaa

SEQ ID NO: 484 - DNA, 2091 bp, Helicobacter pylori J99
atgaaaatcaaaaaatccctctttgctctctctttctctctcatggcttcattatcaagggctgaagatgacggattttacatgagtgtgggctatcaaatcggtgaagcggtccaaaaagtgaaaaacactggagcattacaaaatcttgcagacagatacgataacttgagcaaccttttaaaccaatacaattacttaaattccttagtcaatctagccagcacgcctagcgcgattaccggtgcgattgacaatctaagctcaagcgcgatcaatctcactagcgctaccaccacttctccggcctatcaagctgtggctttagcgctcaatgcggctgtgggcatgtggcaagtcatagcctttggcatcagctgtggccctggccccaatcttggcccagaacatttagaaaatgggggcgttcgatcgtttgacaacacgccaaactacagctacaacaccggtagcggaacgaccaccaccacttgtaatggagccagtaatgtagggcccaatggtatcctatctagcagcgaataccaggttctcaataccgcttatcaaactatccaaaccgctttaaaccaaaaccaaggaggcgggatgcctgccttgaatagctccaaaaatatggtagtcaatatcaatcaaactttcacaaaaaaccctaccacagaatacacttaccccgatgggaatggcaattattattcaggcggttcatcaatcccaatccagctaaagattagtagcgtcaatgacgctgaaaaccttttgcaacaagccgctactatcatcaatgtccttaccacccaaaacccgcatgtgaatggtggcggtggggcatgggggtttggcggtaagaccgggaatgtgatggatatttttggcgatagttttaacgctattaacgaaatgatcaaaaacgctcaagccgttttagaaaaaacccaacagcttaacgctaatgaaaacacccaaatcacgcaaccagacaatttcaacccctacacttctaaagacacgcagttcgctcaagaaatgctcaatagagctaacgctcaagcagagattttgagcttagcccaacaagtagcggacaatttccacagcattcaagggcctatccaacaagatctagaagaatgcaccgcaggatcagctggtgtgattaacgacaacacttatggttcaggttgcgcgtttgtgaaagagactctcaattccttagagcaacacaccgcttattatggcaaccaggtcaatcaggatagggctttgtctcaaaccattttgaattttaaagaagcccttagcactttagggaacgactcaaaagcgatcaatagcggtatctctaacttgcctaacgctaagtcccttcaaaacatgacgcatgccactcaaaaccctaattccccagaaggtttgctcacttattctttggataccagcaaatacaaccagctccaaactgttgcgcaagaattaggcaaaaacccctttaggcgcatcggcgtgattaactatcaaaacaataacggggcgatgaacggcatcggcgtgcaagcgggctataagcaattctttggcaaaaaaaggaattgggggttaaggtattatggtttctttgattataaccatgcttatatcaaatctaatttttttaactcggcttctgatgtgtggacttatggggtgggtatggacgcgctttataacttcatcaacgataaaaacaccaactttttaggcaaaaataacaagctttctgtggggctttttggtggctttgcgttagccgggacttcgtggcttaattcccaacaagtgaatttgaccatgatgaatggcatttataacgctaatgtcagcgcttctaacttccaatttttgtttgatttaggcttgagaatgaacctcgctaggcccaagaaaaaagacagcgatcatgccgctcagcatggcatggaattgggcgtgaaaatccccaccattaacacggattattattctttcatgggggctgaactcaaatacagaaggctctatagcgtgtatctcaattatgtgtttgcttactaa

SEQ ID NO: 485 - DNA, 2091 bp, Helicobacter pylori J99
atgaaaatcaaaaaatccctctttgctctctctttctctctcatggcttcattatcaagggctgaagatgacggattttacatgagtgtgggctatcaaatcggtgaagcggtccaaaaagtgaaaaacactggagcattacaaaatcttgcagacagatacgataacttgagcaaccttttaaaccaatacaattacttaaattccttagtcaatctagccagcacgcctagcgcgattaccggtgcgattgacaatctaagctcaagcgcgatcaatctcactagcgctaccaccacttctccggcctatcaagctgtggctttagcgctcaatgcggctgtgggcatgtggcaagtcatagcctttggcatcagctgtggccctggccccaatcttggcccagaacatttagaaaatgggggcgttcgatcgtttgacaacacgccaaactacagctacaacaccggtagcggaacgaccaccaccacttgtaatggagccagtaatgtagggcccaatggtatcctatctagcagcgaataccaggttctcaataccgcttatcaaactatccaaaccgctttaaaccaaaaccaaggaggcgggatgcctgccttgaatagctccaaaaatatggtagtcaatatcaatcaaactttcacaaaaaaccctaccacagaatacacttaccccgatgggaatggcaattattattcaggcggttcatcaatcccaatccagctaaagattagtagcgtcaatgacgctgaaaaccttttgcaacaagccgctactatcatcaatgtccttaccacccaaaacccgcatgtgaatggtggcggtggggcatgggggtttggcggtaagaccgggaatgtgatggatatttttggcgatagttttaacgctattaacgaaatgatcaaaaacgctcaagccgttttagaaaaaacccaacagcttaacgctaatgaaaacacccaaatcacgcaaccagacaatttcaacccctacacttctaaagacacgcagttcgctcaagaaatgctcaatagagctaacgctcaagcagagattttgagcttagcccaacaagtagcggacaatttccacagcattcaagggcctatccaacaagatctagaagaatgcaccgcaggatcagctggtgtgattaacgacaacacttatggttcaggttgcgcgtttgtgaaagagactctcaattccttagagcaacacaccgcttattatggcaaccaggtcaatcaggatagggctttgtctcaaaccattttgaattttaaagaagcccttagcactttagggaacgactcaaaagcgatcaatagcggtatctctaacttgcctaacgctaagtcccttcaaaacatgacgcatgccactcaaaaccctaattccccagaaggtttgctcacttattctttggataccagcaaatacaaccagctccaaactgttgcgcaagaattaggcaaaaacccctttaggcgcatcggcgtgattaactatcaaaacaataacggggcgatgaacggcatcggcgtgcaagcgggctataagcaattctttggcaaaaaaaggaattgggggttaaggtattatggtttctttgattataaccatgcttatatcaaatctaatttttttaactcggcttctgatgtgtggacttatggggtgggtatggacgcgctttataacttcatcaacgataaaaacaccaactttttaggcaaaaataacaagctttctgtggggctttttggtggctttgcgttagccgggacttcgtggcttaattcccaacaagtgaatttgaccatgatgaatggcatttataacgctaatgtcagcgcttctaacttccaatttttgtttgatttaggcttgagaatgaacctcgctaggcccaagaaaaaagacagcgatcatgccgctcagcatggcatggaattgggcgtgaaaatccccaccattaacacggattattattctttcatgggggctgaactcaaatacagaaggctctatagcgtgtatctcaattatgtgtttgcttactag

SEQ ID NO: 486 - DNA, 2526 bp, Helicobacter pylori J99
ttgcataaaaaagttctgttggctttaactgccagcttgatttgccaagagtctttgttcgctaaggataaagactacactttgggcaaggtttctactgccggtaaaaaggatagatctgactattctgggcaggtcaatttgggttatagcgggattaccgcgcctaagagttggcaagatgaagaagtgaaaaaatacacaggaagccgcacggtgatctctaacaaagcgctcacccaacaagctaaccaaagcattgaagaagctttacagaatgtccccggtctgcaaattaggaatgccacaggtgtgggggctatgcctactatccaaatccgtggctttggagcggggggttcagggcatagcgatgcgacgctcatgttagttaatggtattcctgtttatatggccccttacgctcacattgagctagacattttccctgttacctttcaagccattgatcgcattgatgtgatcaaaggtggaggcagcgtgcaatatgggcctaacacttatgggggtattgtcaatatcatcactaaacctatccctaatcaatgggaaaaccaagcggctgaaaggatcacttattgggctaaggctagaaacgctgggtttgccgctccccctgataaaaccggcgatccttctttcatcaagtctttaggcaacaacctcctctataacacttatgtgaggagcggagggatgatcaataagcatgtgggtatccaagcgcaagctaactgggttagaggccaaggctttagggacaatagcccctctagtatttcaaactattggctggatggggtctatgacatcaatgaaagcaatgggattaaagcctattaccaatactacgattttgctatcgcccaaccgggatcactcagcgagcaagattacaaaataaaccgcttcgctaatttgcgccccttaaaccaaaaaggcgggcgctcacaacgctttggggctgtgtatgaaaaccgcttcggggatttagacagagtgggcgggactttcagcttcacttactacgggcagttgatgactagggactttcaggtgagctctagctacaatagcgctaacatggttacttgttttagcgaagcggcatgcagggcggcagggcttccggcagggtataacttggctgtgccttattatgccactaactacaatggttgggcggaggtagaaaaccctgtgcgttccattaacaacgcttttgagcctaaagtgaatctgatcgtcaataccgggaaagtcaggcaaacctttatcatgggtttgcgtttcatgaccaccacttttttacaacgccaatacttaaacaccaatgaatgcgccactaaaacgagcggtgagggggcaggcttcttgtgtgagggccctaacgtgatgagcggttggaaaccccacatcaagcatggcgtttatagaaactggaataactggcgcaacaattacacagcggtctatttgagcgatcgcattgaagcttgggacgggcgctttttcatcgtgcctggtttgcgctacgcttttgtgcaatacaacaacgaaaatgcgtctaactggatgcaaatccctgagaaggatttaagaaaaatcaagcacatgaacaattggatgccctcaaccaacattggctttatccctgtgcaaggcgatcacaatgtgcttacctacttcaactaccaacgctctttcgtcccgcctcaattagacgttttgagctatggaggagcggagtattttacccaacactttgacacggtggaagcaggagcgcgctacacctataaagataaattcagcttcaatgcggactactttaggatttgggcgcgcgattttgccaccgggcagtattcagtctatacgagcgggcccatgaaaggtaatgtgcgccccattaatggctattctcaaggcgtggagctggaattgtattacaggcccattagagggttgcaattccatgccgctttcaactacattgacactcgtgtaactagccatggccctttaaccgacttgaacggggatgtgctaaaagggactagctataacaagcatttcccttttgtaagccctttccaattcatttttgacgctcgctacaattggcgtaaaaccaccattggtatttctagctatttttatagccgtgcttatagcgggattagcaacagcgcagcaggaggctattatgggatgcaatactatagtggggggaacaactatgaaagcgttcttaatagcggttatcaatgcgaagcttggtgtatgacccaacatgaagggctcttgccttggtattgggtgtggaatatccaagtgagccaaattttctgggaaaacggaagacacagagttacaggaagcttacaaatcaataacatcttcaacatgaagtattattttacagggattggctctagccctgcaggcttgcaacctgcgcctggaagatcggttacagcgtatttgaactacactttctaa

SEQ ID NO: 487 - DNA, 2007 bp, Helicobacter pylori J99
atgaaaaaaacccttttactctctctctccgcttcatcgcttttaaacgctgaagacaacggcttttttatcagcgcgggctatcaaatcggtgaagccgctcaaatggtgaaaaacaccggcgaattgaaaaaactttcagacacttatgagaatttgagcaaccttttaaccaattttaacaacctcaatcaggcggtaacgaacgcgagcagcccttcagaaatcaatgctgcgatcgataatttaaaagcaaacacgcaagggctaattggcgaaaaaaccaattccccggcgtatcaagcggtgtatttggcgctcaatgcggcggtagggctgtggaatgtcatcgcctataatgtccaatgcggtcctggtaacagtggacaacaaagcgtaacctttgagggccaaccaggacataattcaagttccattaattgcaatttaaccggttataacaacggggttagcggccctttatccattgagaattttaaaaagcttaatcaggcttatcaaactatccaacaagctttaaaacaagatagcggatttcctgttttggatagtgcaggaaaacaagtaactataacaataacaacgcaaactaatggagctaataaaagtgaaactactactactactactactactaatgacgctcaaacccttttgcaagaagccagtaaaatgataagcgtcctcactacaaactgcccatgggtcaatcacaatcaaggacaaaacgggggcgcgccgtggggtttagatacggcagggaatgtgtgtcaggtttttgccacggaatttagcgccgttactagcatgatcaaaaacgcccaagaaatcgtaacgcaagctcaaagccttaaccagcaaaacaatcaaaacgcgccgcaagatttcaatccttacacctctgctgatagggctttcgctcaaaacatgctcaatcacgcgcaagcgcaagccaagatacttgagctagccgatcaaatgaaaaaagaccttaacactatcccaagccaatttatcacaaattacttggcagcttgccacaatgggggtgggacattacctgatgcgggggttactaacaacacttggggggccggttgcgcgtatgtggaagagacgataacggctttaaacaacagccttgcgcattttggcactcaagctgagcaaatcaagcaatctgagttgttggcgcgcaccatacttgattttagaggcagccttagtaatttaaacaacacttataacagcatcaccacgaccgcttcaaacacgcctaattccccattccttaaaaatttgataagccaatccactaaccctaataaccccgggggcttacaggccgtttatcaagtcaaccaaagcgcttattcgcaattattaagcgccacgcaagaattagggcataaccctttcagacgcgttggattaatcagctctcaaaccaacaatggtgccatgaatgggatcggtgtgcaagtgggctacaaacaattttttggtgaaaagagaaggtgggggttaaggtattacggcttttttgactataaccatgcttatatcaaatctagctttttcaattcggcttctgatgtgttcacttatggggtagggacagatgtcctctataactttatcaatgataaaaccaccaaaaacagcaagatttcttttggggtgtttggggggattgcgttagctggcacttcatggctgaattcccagtatgtgaatttagcgaccttcaataatttctatagcgctaaaatgaatgtggcgaatttccaattcttgttcaatttaggcttgagaatgaacctcgctaagaataagaaaaaagcgagcgatcatgcggctcagcatggcgtggaattaggcgtgaagatccccacgatcaacacgaattactattctttgctaggcactcaactccaataccgaagattgtatagcgtgtatttgaattatgtgttcgcttactaa

SEQ ID NO: 488 - DNA, 2007 bp, Helicobacter pylori J99
atgagaaaactattcatcccacttttattattcagcgctttagaagcgaacgagaaaaacggctttttcatagaagccggctttgaaactgggctattagaaggcacacaaacgcaagaaaaaagacacaccaccacaaaaaacacttacgcaacttacaattatttacccacagacacgattttaaaaagagcggctaatttattcaccaatgccgaagcgatttcaaaattaaaattctcatctttatcccctgttagagtgttgtatatgtataatggtcaattaactatagaaaacttcttgccttataatttaaataatgttaagcttagttttacagacgctcaaggcaacacgattgatctaggcgtgatagagaccatccccaaacactctaagattgttttacccggggaggcgtttgatagtttaaaagaggcgtttgataaaattgacccctatactttatttcttccaaaatttgaagccactagcacttctatttctgatactaacacgcagagggtgtttgaaacgctcaataacattaaaacaaatcttataatgaaatatagtaatgaaaatccaaacaatttcaacacttgtccttacaataataatggtaatacaaaaaatgattgttggcaaaatttcaccccacaaaccgcagaagaattcaccaatttaatgttgaacatgatcgctgtcttagactcccaatcttggggcgatgcgatcttaaacgctccttttgaattcactaacagctcaacagattgcgatagcgatccttcaaaatgcgtaaatcccggagtaaatgggcgtgttgatactaaagtcgatcaacaatatatactcaacaaacaaggtattattaataattttagaaaaaaaatagaaattgatgcggttgttttaaaaaattcaggggttgtagggttagccaatggatatggcaatgatggtgaatatggcacattaggggtagaagcctatgctttagatcctaaaaaactctttggcaacgaccttaagactatcaatttagaagatttaagaaccatcttgcatgaattcagccacactaaaggctatgggcataacgggaatatgacctatcaaagagtgccggtaacgaaagatggtcaagtggaaaaggatagtaatggcaagccaaaagattctgatggcctcccctataatgtgtgttcgctttatgggggatccaatcagcccgctttccctagcaactaccctaattccatctatcacaattgtgcggatgtcccggctggctttttaggggtaacagcagcggtttggcagcagctcatcaatcaaaacgccttgccgatcaactacgctaacttggggagtcaaacaaactacaacctaaacgctagtttaaacacgcaagatttagccaattccatgctcagcaccatccaaaaaacctttgtaacttctagcgttaccaaccaccatttttcaaacgcatcgcaaagttttagaagccctattttaggggttaacgctaaaataggctatcaaaactactttaatgatttcatagggttggcttattatggcatcatcaaatacaattacgctaaagctgttaatcaaaaagtccagcaattgagctatggtggggggatagatttgttattggatttcatcaccacttactccaataaaaatagccctacaggcattcaaaccaaaaggaatttttcttcatcttttggtatctttggggggttaaggggcttgtataacagctattatgtgttgaacaaagtcaaaggaagcggcaatttagatgtggctaccgggttgaactaccgctataagcattctaaatattctgtagggattagcatccctttaatccaaagaaaagctagcgtcgtttctagcggtggcgattatacgaactcttttgttttcaatgaaggggctagccactttaaggtgtttttcaattacgggtgggtgttttag

SEQ ID NO: 489 - DNA, 663 bp, Helicobacter pylori J99
atgaataaaacaacaattaaaatattaatgggcatggcgttattatcatcgcttcaagccgcagaggcagagcttgatgaaaaatcaaaaaaacctaaatttgcggataggaatacgttttatttaggggttgggtatcagcttagcgcgatcaacacgtcttttagcaccagttctatagataaatcgtatttcatgaccggcaatggttttggcgtggtgttgggggggaaatttgtggctaaaacgcaagctgtagagcatgtgggttttcgttacgggttgttttatgatcagaccttttcttctcacaaatcctatatttctacctatggtttagaatttagcggtttgtgggacgctttcaattcgccaaagatgtttttggggttggagtttggcttaggcatcgctggggcgacttacatgccaggaggggccatgcatgggattatcgctcaatatttaggcaaagaaaattcgcttttccaattgcttgtgaaagtgggttttcgttttggctttttccacaatgaaatcacctttgggttgaaattccctgtcattcctaacaaaaaaacggaaatcgttgatggcttgagcgcgaccactttatggcaacgcttgccggtagcctatttcaattatatctataatttttag

SEQ ID NO: 490 - DNA, 1932 bp, Helicobacter pylori J99
atgaaaaaaacgaaaaaaacgattctgctttctctaactcttgcggcgtcattgctccatgctgaagacaacggcgtttttttaagcgtgggctatcaaatcggtgaagcggttcaaaaggtgaaaaacgccgacaaggtacaaaagctttcagacgtttatgaacaattaagcaagcttttagccaacgataatggcactagctcaaaaacaagcgcgcaagcgatcaatcaagcggttaataatttgaatgaaagcgcaaaaactttagccggtgggacaaccaattcccctgcctatcaagccacgcttttagcattgagatcggcgttagggttatggaatagcatgggctatgcggtcgtatgcggaggttatattaaaaaaccgggcgaaaacaatcaaaaaaatttccactacaccgatgagaatggcaacggcactacaatcaattgcggtgggagcacaaatagtaatggcactcatagtcctaatggcacaaatacattaaaagcagacaaaaatgtttctctatctattgagcaatatgaaaaaatccatgaagcctatcaaatcctttcaaaggctttaaaacaagctgggcttgctcctttaaatagcaaaggggaaaagttagaagcgcatgtaaccacatcaaaggatcaacaaggaacatccagtgaccaaactacaaccacaacttctgttattgatacgactaatgatgcgcaaaatcttttgactcaagcgcaaacgattgtcaatacccttaaagattattgccccatgttgatagcgaaatctagtagtaatggtggaactaatggcgcaaacaccccttcatggcaaacagccggtggcggcaaaaattcatgtgcgacttttggtgcggagtttagtgctatttcagacatgattagtaacgctcaaaaaatcgttcaagaaacccaacaacttaacgccaaccaacccaaaaatatcacccaacccaataatttcaaccttaactctcctggcagtcttacggctttagctcaaagcatgctcaaaaacgctcaatctcaaacagaaattttaaaattagccaatcaggtagcaagcgattttgacaaactttcttcaggctatcttaaagattacatagggaaatgcgatgtgagtggtgtgagtagttcaaatatgacaccgcaaaatatgaataccacttgggggaaaggctgcgcgggcgtggaagaaactctaacttcgttaaaagcaagcaccactgattttaacaaccagacaacgccccaactcgatcaagcgcaaaccctagccaatacccttactcaagaactcggcaataaccctttcaaacgagtgggtatcattggctctcaaaccaataacggggcgatgaatggccttggggtgcaagcgggttataagcaattctttggtcaaaaaagaaggtgggggttaaggtattacggcttttttgactacaaccatacctacatcaaatccagcttttttaactcgtcttctgacgttttgacttatggggtgggtagcgatttattgtttaatttcatcaatgataaaaacaccaatttcttaggcaagaacaataagatttctgtggggctttttggaggtatcgccttagcagggacttcgtggcttaattctcaattcgtgaatttaaaaaccatcagcaatgtttatagcgctaaagtgaatacggctaatttccaattcttattcaatttaggcttgagaaccaatctcgctaggcctaagaaaaaagacagcgatcattccgcgcaacatggcatggaattgggcgtgaaaatccctaccattaacacgaattactattcttacttgggaactaaactagaataccgaagactctatagcgtgtatctcaattatgtgtttgcgtattga

SEQ ID NO: 491 - DNA, 1452 bp, Helicobacter pylori J99
atgaaaaaaacgattttactttctctcatggtgtcatcgctctttgctgaaaatgacggcgtttatatgagcgtgggctatcaaatcggcgaagccgcacaaatggtgaaaaacaccggcgaaatccaaaaagtctccaacgcttacgaaaatttgaacaaccttttaacccgctataatgaactcaaacaaacggcctctaacactgattcaagcaccgctcaagcgattgacaatctagaaaagagcgctagcagattgaaaacgacccctaataccgccaatcaagccgtgtcctcagcgctcagctctgcggtgggcatgtggcaagtgatagcctctaatttagccaacaactcgctatcttctagcgaatacgaaaaactcaaagcgacttctcaattgctccaaaataccctagaaaataaaaacaataatcttaaaattgaaaatgactatgaccagcttttaactcaagctagtaccattattaatacccttcaaagccaatgcccaggcgtagatgggggcaatggcaaaccatggggcattaatacaagcgggaacgcatgcgctatttttggtagcacctttaacgccattaatagcatgattgatagcgctaaaaaagccgccgcagatgcccgaagaactgccccagaaagtccaaaccaacaaaacgcgtttaccaacgctgatttcaataaaaacctcaatcaagtctcaagcgttatcaatgacaccatctcttacctcaaaggggacaatttagaaaccatctacaacaccattcaaaaaacgcctaattctaaagggtttcaaagtttggtgagccggtctagctatagttattctctcaacgaaacccaatattctcaattccaaactaccaccaaagagtttggtcataaccccttcagaagcgtgggattaatcaactctcaaagcaataacggggcgatgaatggcgtgggcgtgcaactaggctataagcaattctttgggaaaaataaattttttgggatccggtattatggcttttttgattacaactatgcgtatatcaaatccaattttttcaactccgcttccaatgttttcacctatggcgcgggcagtgatcttttattgaacttcatcaatggcggatccgatcgaaaccgcaaagtctcttttggcatttttgggggcatcgctctagcgggaacgacatggcttaataaccaatctgcgaatttaaaaatcaccaatagcgcctacagcgctaagatcaacaacaccaatttccaattcttgttcaataccggtttaaggcttcaagggatccatcatggcattgaattaggcgtgaaaatccctacgatcaacaccaattactattctttcatgggcgctaaattagcctaccgcaggctttatagcttgtacctcaattatgttttggcttattga

SEQ ID NO: 492 - DNA, 1416 bp, Helicobacter pylori J99
atgccaaaggcaagtcaggttttattctttggagcgtttttaagcacttctttacaaggttttgaagctaagctcaacggctttgtggatcaatccagcacgatcggttttaaccagcataaaatcaataaagaaagaggcatctaccctatgcagcaattcgcaacgattgcgggctatttagggcttggttttagcctgttacccaaaaaggtttcagaccatgttctaaaaggcaaaatagggggcatggtcggatctattttctatgacggcacgaagaagtttgaagacggctctgtggcttacaacctctttggttattacgatgggtttatgggggtctatactaatatcttacaaaccgatagccttgagacacagaacatgaaacacaacaaaaatgtccgcaattatgtctttagcgacgcgtatttagaatacgcttataagaattattttgaaataaaagccgggcgctatctctccactatgccttataaaagcggtcaaacgcaaggctttcaagtttctgggcaatacaagcatgcgcgcttgacttggtttagctcatggggtagggcgtttgcttatggttcgtttttaatggattggtttgccgcacggaccacttatagcggaggctttaccaaaaacaataatggaggttatgatagccatgggcgaaaggtgctttatggcacgcatgcggtgcaactcacctataaacctcatcgtttcctcatagaaggcttttattacctttcgcctcaaatctttaacgctccaggcgttaagattggttgggactctaaccctaattttagcggcacaggctttcgctctgatacggctatcatagggtttttccccatttactacccttggatgatcgttaaatccaatggaagcccggtctatagatacgacacgcctgccactcaaaacgggcaaaacctcattatccgccaacgctttgacatcaacaattacaatgtttcaatcgctttttataaagtctttcaaaacgctaatggttggataggcaacatggggaatccaagcggtgtgatcatggggagtaacagcgtctatgcaggttttacaggcacagcccttaaaagagacgccgctaccattttcctttcttgtggtggcactcattttgccaaaaaattcacatggaaattcgccacacaatactccaattcagtggtctcttgggaagcaagagcgatgatctctttaggctataaattcactgaatatttgagcggtagcgtggatcttgcgtattatggcgtgcatactaacaaaggctttaaaccgggtgaaaacgggcctgtgcctaaaaacttccccgccctttattctgacaggagcgctttatacacggctctagtagcgtctttttga

SEQ ID NO: 493 - DNA, 2256 bp, Helicobacter pylori J99
atgctaaggctcgttagtaaaacgatttgtttgtctttaattagcttgttcaaccctttagaagcctttcaaaaacaccaaaaagacgtcttttttgtagaagctgggtttgaaaccgggctattagaaggcgcgcaaaccaaagaacaagcaatagcccaaaacacccaaaacacccaaaaaatttatgaaaaccccctaacccacccccaaactaaagaacaacctaaagaacaaaacaaaagcgatacagccaccccacaaagcgtctatgggagatactacatcctccaaaacaccattttagaaaaagcgactgagctattcacagcggctaatatcaatggcaacggcttaactttttattctcaaaaccctgtgtatgtgatggcatacaataaagataatgccgagtttgaaggctatggcaataacagcgtggttgtgatacaaaacttcctgccctacaatttaaacaatattgagctgagttatacagacgctcaaggcaaggcagtcaatttaggcgtgatagagaccatccctaaagattctcaaatcatcttgcctgcaagtttgtttaataatttttcaaacgattcaccattcaactctgatggcctccaacaactccaaaccactaccacccccttttctgatgctaacacgcagagtttgtttgaaaagctcagtcaaatcacgaccaatcttcaaatgacttatgagaatacagaccccttttctagcggcaacaacgatcctaatggccctctcgcttctcctaaacctcattatgaatgccctggttataaaaagagttgtcaagtcgcttcggtgtctttcaccccacaaaccgcagaagaattgaccaatttaatgttagacatgattgcggtgtttgactctaaatcttgggaagaagccgttttaaacgcccctttccaattttctaacagcccatcagagtgcggcattgattaccctaaatgcgttaatccctttaataacgggcttgttgatcctaaagatgaaaaatacgcgctaaccccagaagaggttatcaatagttatagagtcgccaatgaacttaccgtgaacctcttgaatgcggccaaggggtttctagggctaggatcccaactgggtagcgccaatgcccccgatgatgatggcttcaatcaaggtgttttagggatagcgccttttgctttagatcctgaaaaattgttcggtaaaaatttgaataaagtggctattttggcattaagagacattatccatgaatatgggcatactttaggctatacccataacgggaacatgacttatcaaagggtgcgtttatgccaagaaggaaacgggccagaggcacgctgtgagggcgggcatgaagtggagaaaaacggcaaagaagagctagaattcagtaatgggcatgaagtgcgagaccatgatggttacacctatgatgtttgctctcgttttggcggcaaaaatcagcccgctttccctagcaattaccccaattccatctataccaattgcgctcaagtccccgctgggcttataggggttactaccgctgtttggcaacagctcatcaatcaaaacgccctgcccattaatttcgctaacctaaatagccaaaccagccatttaaacgccgggttgaatgcgcaaaattttgcaacctctatggtcagcgcgatcgcgcaaaatttttccaccacttccactaccacttaccgctcttcaagtaagaattttagaagccctattttaggggttaatgttaaaataggctaccaacattatttcaatgactacatcgggttagcctattacggcattatccaatacaactacgctcaagctaacgatgaaaaaatccagcaattaagctatggtgggggaatggatgtgctgtttgatttcatcaccacttacaccaataaaaagcaagaccatccaactaaaaaggtttttgcttcctcttttggggtgtttggggggttaaggggcttatacaatagctactatgtcttcaatcaagtcaaaggaagcggtaatttagatatagtaaccgggtttaattaccgctacaagcattctaaatattccataggcgttagcgttcctttaatccaaagcggtattaagatcgcttctaataatggtatctatgcagactctgttgttttgaatgaagggggtagccattttaaagtgttttttaattacgggtgggtattttaa

SEQ ID NO: 494 - DNA, 2094 bp, Helicobacter pylori J99
ttgcaaaactttgtttttaataaaaaatggctcatctattctagcctactccccttattttttcttaaccctttaatggcagaagacgatgggttttttatgggggtgagttatcaaacttctttggccgttcaaagggtggataactcagggcttaacgccagtcaagacgcatccacttatatccgccaaaacgctatcgctctagaatctgcggcggtgcctttagcctattatttagaagcgatgggccaacaaacgagagtcttaatgcaaatgctctgccctgatccttctaaaagatgtttgctctatgcagggggctatcaaaacggacaaaataataacggcgatacaggcaacaaccccccaagaggcaatgtcaatgccacctttgatatgcaatctctagtcaataatttaaacaagctcacccaactcatcggcgaaactttaatccgtaaccctgaaaatcttcctaactccaaagtctttaacgtcaaatttggcaatcaaagcactgttattgcattgcctgagggtctagccaataccatggacgctttaaacaatgacatcaccaacgctttaaccacgctctggtataaccaaaccttaacgaataaatcttttagcacccctagtaacacttctgtgaattttagcccccaagtcttgcaacaccttttacaagacggcttagccacagcaaataataatcaaaccatttgcagcactcaaaaccaatgcaccgccactaatgaagctaaatctatcgctcaaaacgcccaaaacatcttccaggctttaatgcaagcagggattttagggggcttagccaatgaaaagcaatttggcttcacttacaacaaagcccccaatggcagcgattcccaacaaggctatcaaagctttagcggcccgggttattacaccaaaaacgacaacaccacgcaagcgcccttaaaagcattacccgctggagcgacaattggatcaggcaatggccaatacacctaccaccccagctcggcagtctattatttagccgatagcatcatcgctaatggcatcaccgcttctatgattttttcaggcatgcaaaatttcgccaataaagccgctaaactgataggcacttcaagctataaccagatgcaagatgcgatcaactatggggaaagcttgcttagtaacaccgtagcgtatggggatttcatcaccaattgggtcgccccctatttggatttaaacaataaaggtttgaatttcttgcctaattatggggggcaattgaatggcgctaataatcaaaccccacaattaaccccacaacaagcccaacaagaacaaaaagtgatcatgaaccaattagagcaagccacaaacgcccccacccccgcgcaaataaacaggattttagccaacccctattcccccacggcaaaaactttaatggcttatgggctctatcgctctaaagcagtgattggcggagtgattgatgaaatgcaaactaaagtgaatcaagtctatcaaatgggctttgctaggaattttttggagcataactctaattctaataacatgaacggctttggcgtgaaaatgggctataagcaatttttcggcaaaaagcgcatgtttgggcttaggtattatggtttttatgattttggttacgctcaatttggcacagaatcttctttagtgaaagccaccctctctagctatggagcgggcacagactttctttataatgtttttacccgaaaaagagggactgaagcgatagatataggtttttttgccggtatccaacttgcagggcaaacctggaaaacgaattttttagatcaagtggatggcaaccatcttaaacctaaggacacttctttccaattcctttttgatttgggcataaggaccaatttttccaaaatcgctcatcaaaaaagatcccgtttttctcaagggatagaatttggccttaaaataccggtgctttatcacacctattaccaatcagaaggcgttacagcgaagtatagaagagactttagtttttatgtgggctacaacataggcttttga

SEQ ID NO: 495 - DNA, 1956 bp, Helicobacter pylori J99
atgaaaaagacaattctactctctctctctctctctctcgcttcatcgctcttgcacgctgaagacaacggcttttttgtgagcgcgggctatcaaatcggcgaagcggtgcaaatggtcaaaaacaccggtgaattgaaaaacttgaacgaaaaatacgagcaattaagccagtatttaaatcaagtggcttcgttgaagcaaagcattcaaaacgccaacaacattgagctggtcaatagctctttaaactatttaaaaagctttaccaacaacaactacaacagcaccacccaatcgcccatctttaacgccgtgcaagccgttatcacttcggtattgggtttttggagtctttatgcggggaactatctcactttttttgtggttaataaggatactcaaaaacccgctagtgtccagggtaaccctcctttttcaactattgttcaaaactgctcaggaattgaaaactgcgcgatgaatcaaaccacttatgataagatgaaaaagctcgctgaagatctccaagcagcccaacaaaacgctaccactaaagcgaacaatctttgcgctttatccggatgcgccacaacacaaggccaaaacccaagctcaaccgtaagcaacgctcttaacttagcgcaacagcttatggatttgatcgcaaacactaagacggctatgatgtggaaaaatatcgtcatcgctggcgtttcaaacgtatccggcgctatcgattccactggctacccaacgcaatacgcggtgtttaacaacattaaggcgatgatacctatcttgcaacaagcggttacgctttctcaaagtaaccacacattatctgctagcttgcaagctcaagctacaggatctcaaacaaaccccaaattcgctaaagacatctacgctttcgctcaaaaccaaaagcaagtcatttcttacgctcaagacattttcaacctctttagttctatccctaaagatcagtatcgttatttagagaaagcctatttgaaaatacccaatgcgggtaaaacgcctactaacccttacagacaggaggtgaatttaaaccaagaaattcaaacgatccaaaacaatgtgagttattatggtaatcgggtggatgcggctttaagcgtggctaaagatgtttataatttaaaatccaatcaaacagaaatcgtaaccacctataacaacgctaagaatttgagccaagagatttctaaactcccctataaccaagtcaatacaaaagacattatcacactgccttacgatcaaaacgctccggcagcgggccaatacaactaccagatcaacccagagcagcaatccaatctttctcaagctttagcggcgatgagcaataacccctttaaaaaagtgggcatgatcagctctcaaaacaataacggcgctttgaacgggcttggcgtgcaagtgggttataaacaattctttggcgaaagcaaaagatgggggttaaggtattatggtttctttgattacaaccacggctatatcaaatccagcttttttaattcttcttctgatatatggacttatggcggtgggagcgatttgttagtgaattttatcaacgatagcatcacaagaaagaacaacaagctttctgtgggtctttttggtggtatccaactagcagggactacatggcttaattctcaatacatgaatttaacagcgttcaataacccttacagcgcgaaagtcaatgcttccaatttccaatttttgttcaatctcggcttgaggacgaatctcgctacagctaagaaaaaagacagcgaacgttccgcgcaacatggcgttgaactgggcattaaaatccctaccattaacaccaattattattcttttctaggcactaagctagaatacagaaggctttatagcgtgtatctcaattatgtgtttgcttattaa

SEQ ID NO: 496 - DNA, 2235 bp, Helicobacter pylori J99
atgttaaaactcgccagtaaaacgatttgtttgtccctaatcagctcattcacggctgtagaagcctttcaaaaacaccaaaaagacggctttttcatagaagccggctttgaaaccgggctattacaaggcacacaaacccaagaacaaaccatagccaccactcaagaaaaacccaaacccaaacccaaaccaaaacccattacccctcaaagcacctatgggaaatactacatctcccaaagcaccattttaaagaatgcgactgagttgtttgcagaggataatatcaccaacttaaccttttactctcaaaaccctgtgtatgtaaccgcttataaccaagaaagcgctgaagaagctggctatggtaataacagcttgattatgatacaaaacttcttgccttataacttgaacaacattgagctgagttacacggacgatcaaggcaatgtggtcagtttgggcgtgatagagactatccctaaacaatctcaaatcattctgcccgcaagcttgtttaacgacccacagcttaacgccgatggcttccaacaactccaaaccaacaccacacgattttctgatgccagcacgcagaatctgtttaacaagctcagcaaggttacaaccaatcttcaaatgacttatatcaattacaaccaattttctagcggtaacggcagtggctctaaacccccatgccccccatacgaaaaccaagcaaattgtgtggctaaagtgccgcctttcacctctcaagacgctaaaaatttgaccaatttaatgctgaacatgatggcggtgtttgattctaaatcttgggaagacgccgtcttaaacgctcctttccaattcagcgacaacaacctgtcagcgccatgttattctgattaccttacatgcgtgaatccttacaacgatgggcttgttgatcctaaattgatcgccaaaaataaaggagatgaatacaatatagaaaacgggcaaacaggctcagtgatattaacgccgcaagatgttatctatagctatagagtcgctaataatatttatgtgaatctcttgcccacaagaggaggggatttagggttagggtctcaatatggtggcccgaatggcccaggcgatgatggcaccaattttggcgctttagggatattgtcccctttcttagaccctgaaatattgtttggcaaagaattgaataaagtcgccatcatgcaattaagagacatcatccatgaatacggccatactttaggctatacgcataacgggaacatgacttatcaaagagtgcgcatgtgcgaagaaaacaatgggccagaagagcgctgtcagggcggaaggatagagcaagtggatgggaaagaagtgcaagtgtttgacaacgggcatgaagtgcgagacaccgatggctctacctatgatgtgtgttctcgttttaaagataagccctatacagcgggcagctatcctaattccatctataccgattgctctcaagtccccgctgggcttataggcgttaccagcgctgtttggcaacaactcattgatcaaaacgccctaccggtggattttactaatttgagcagccaaaccaactatttgaacgccagcttgaacacgcaagactttgcgaccaccatgcttagcgcgatcagtcaaagcctttcatcttctaaatctagcgccactacttatcgcacttcaaaaacctcacggccctttggagcccccctattaggcgttaatcttaaaatgggctatcaaaaatattttaatgattatctagggttgtcttcttatggcattatcaaatacaactacgctcaagccaacaacgaaaaaatccagcaattaagctatggcgtgggaatggatgtgctgtttgatttcatcaccaattacactaacgaaaagaaccccaaaagcaatctaaccaagaaagttttcacttcctctcttggggtgtttggggggttaaggggcttatacaacagctattatttgttgaaccaatacaaagggagcggtaatttaaatgtgaccggtgggttgaattaccgctacaagcattccaaatattctataggcattagcgttcctttggtccagttgaaatctaggatcgtttctagcgatggtgcttataccaattctatcaccctcaatgaagggggcagtcattttaaagtgttttttaattacgggtggattttctaa

SEQ ID NO: 497 - DNA, 1974 bp, Helicobacter pylori J99
atgagaaaactattcatcccacttttattattcagcgctttagaagcgaacgagaaaaacggctttttcatagaagccggctttgaaactgggctattagaaggcacacaaacgcaagaaaaaagacacaccaccacaaaaaacacttacgcaacttacaattatttacccacagacacgattttaaaaagagcggctaatttattcaccaatgccgaagcgatttcaaaattaaaattctcatctttatcccctgttagagtgttgtatatgtataatggtcaattaactatagaaaacttcttgccttataatttaaataatgttaagcttagttttacagacgctcaaggcaatgtgatcgatctaggcgtgatagagactatccccaaacactctaagattgttttgcccggagaggcatttgatagtctaaaaattgacccctatactttatttcttccaaaaattgaagccactagcacttctatttctgacgctaacacgcagagggtgtttgaaacgctcaataagattaagacaaatttggtcgtaaattataggaatgaaaacaaatttaaagatcacgaaaatcattgggaagcctttaccccacaaaccgcagaagaattcactaatttaatgttgaacatgatcgctgttttagactcccaatcttggggcgatgcgatcttaaacgctccttttgagttcactaacagcccaacagattgcgataatgatccttcaaaatgcgtaaatcctgggacaaacgggcttgtcaattctaaagtcgatcaaaaatatgtgttaaacaaacaagacattgtcaataaatttaaaaacaaagcggatcttgatgtaattgttttaaaggattcaggggttgtagggcttgggagtgatattacccctagcaacaatgatgatggcaagcattatggccagttaggggtagtagcttctgctttagatcctaaaaaactctttggcgataaccttaagactatcaatttagaggatttaagaaccatcttgcatgaattcagccacactaaaggctatgggcataacgggaatatgacctatcaaagagtgccggtaacgaaagatggtcaagtggaaaaggatagtaatggcaagccaaaagattctgatggcctcccctataatgtgtgttcgctttatgggggatccaatcagcccgctttccctagcaactaccctaattccatctatcacaattgtgcggatgtcccggctggctttttaggggtaacagcagcggtttggcagcagctcatcaatcaaaacgccttgccgatcaactacgctaacttggggagtcaaacaaactacaacctaaacgctagtttaaacacgcaagatttagccaattccatgctcagcaccatccaaaaaacctttgtaacttctagcgttaccaaccaccatttttcaaacgcatcgcaaagttttagaagccctattttaggggttaacgctaaaataggctatcaaaactactttaatgatttcatagggttggcttattatggcatcatcaaatacaattacgctaaagctgttaatcaaaaagtccagcaattgagctatggtggggggatagatttgttattggatttcatcaccacttactccaataaaaatagccctacaggcattcaaaccaaaaggaatttttcttcatcttttggtatctttggggggttaaggggcttgtataacagctattatgtgttgaacaaagtcaaaggaagcggcaatttagatgtggctaccgggttgaactaccgctataagcattctaaatattctgtagggattagcatccctttaatccaaagaaaagctagcgtcgtttctagcggtggcgattatacgaactcttttgttttcaatgaaggggctagccactttaaggtgtttttcaattacgggtgggtgttttag

SEQ ID NO: 498 - DNA, 660 bp, Helicobacter pylori J99
atgagtctagctacgagttacaatgtgagtaataatttttctaagtttaatattaagagagtcagaggatatttgatttgtcttgtttgtaacacacctaaaatgatacaaagaggattgaatggtgtctcattttatggttgctctgattatgtaaataaaggcgactgtaagggcgttttacgagaaataaatggctcaatgaaaatggtctgcttacattgtgaaaacacgcccataatggaaaaagtagaaagtggtaggggaggagcttacgcttgtaagaattgcaataggaagttttactttatcgatcttgcaaaacaaaacgaacgaaaaaaagatttagaaaaagaaaaaaaagaattgcttaataagattgaaaagcaaaaaatcaaacaccttgagcgtttcattttggctggtgtaaaagctaatattaaagaaaattcttttttcttaggatgtaaaaattatcctaagtgcgaatggactgctagtatggattcacaagatcttaaatgtcccaaatgcaacagattaatgaaaagaaaaaagaatttcaaaaacaatgagttttttacagctacatcgcttaccttaaatgcaatagaattttgtctctatattaatttgaaaaaaaaggaaaccaatgtttag

SEQ ID NO: 499 - DNA, 1398 bp, Helicobacter pylori J99
ttggaaattaagaaatattttctttacgctctattttttttgcttttttctggtctttttttatccaaacttcaagcttataaattcaacatgagtattgttggaaaggtgagcagctatactaagtttggctttaacaaccaaagataccagccttctaaagacatttatcctacaggtagttatacttctttactcggcgaattgaatttgagcatgggattatacaagggcttgagggcagaagtaggggctatgatggcagcgcttccctatgactctaccgcctatcaaggcaataatatccctaatggccagcccggatctaggacggatccttttggggcgggtatcttttggcaatacattggctggtatgcaggacatagcggtttaaacgtgcaaaaacctcgtttggctatggtgcataacgcttttttgagctacaactacaagaaagacaaattcagttttggcgtgaaaggggggcgctatgatgctgaagagtatgattggttcacttcttacactcaaggggttgaaggctttgtcaaatacaaagacaccaggttaagggtgatgtattcagacgctagggcttcagcgtcaagcgactggttttggtattttgggcgttactatacaagcggtaaggctctaatgattgcggatttgaaatacgaaaaagacaacctaaaaatcaacccttatttttatgcgatctttcaaagaatgtatgcgccaggcattaatatcacttacgacaccaaccctaatttcaacaataagggctttcgttttgtaggcactttcgtggggtttttccccatttttgccactccggctaatcaaaatgatattatcctattccaacaagtgccattaggaaagagcgggcaaacttatttcttccgcactcgtttttactataacaagtggcaatttgggggtagcgtctataaaaatatcggtaacgctaatggcgatataggtatttatggcgaccctctagggtataacatttggacgaatagtatttatgacgcagaaattaacaatatcgttggcgctgatgttattaacgggtttttatatgtaggctcgcagtatagggggtttagttggaaaattttaggccgttggacggatagcccaagggctgatgaaaggagtctcgcgctctttttgagttatttttctaataagtataatattagaatggatttgaaactagaatattatggcaatatcaccaaaaaaggctattgtattgggtattgtggcatgtatgttccagttgatcctaatgggcctggcacgcaacctttaacacacaacgtgtattctgacaggagccatatcatgtttaacattacttatggttttaggatttactag

SEQ ID NO: 500 - DNA, 1917 bp, Helicobacter pylori J99
atgaaaaagacaattctactctctctctctctctctctcgcttcatcgctcttgcatgctgaagacaacggcttttttgtgagcgcgggctatcaaatcggcgaagcggtgcaaatggtcaaaaacaccggcgaattgaaaaacttgaacgacaaatacgagcagttaagccaatctttagcccaactggcttcgttaaaaaaaagcattcaaacggcgaacaacattcaggctgtcaacaatgctttaagcgatttaaaaagctttgcgagtaacaaccacacaaacaaagaaacatcgcccatctacaacaccgcgcaagctgttatcacttcagtattggctttttggagtctttatgcagggaacgctctcagttttcatgtgaccggtttgaatgatggatctaattctcctttaggaagaatccatagagatgggaactgcacaggattacaacaatgttttatgagcaaagaaacttatgataaaatgaagacacttgccgaaaacctccaaaaagctcaaggcaatctctgtgccttatcagaatgctctagcaatcaatcaaatggaggcaaaacttccatgactacagctcttcaaaccgcgcaacagctcatggacttaatcgaacagaccaaggtttctatggtgtggaaaaatatcgtcatcgcaggtgttacaaacaaacccaatggtgctggcgctatcacatccactggtcatgtaaccgactatgcggtgtttaacaacatcaaggcgatgctacctatcttgcaacaagcgcttacgctttctcaaagtaaccacaccctatccactcagttgcaagctcgagctatgggatctcaaacaaatcgtgaattcgctaaagacatctacgctttagctcaaaaccaaaagcaaatcctttctaacgcttcaagtatcttcaatctctttaattccattcctaaagaccaacttaagtatttggagaacgcttacttgaaagtgccacatttgggtaaaacccctactaacccttacagacagaatgtgaatttgaataaagaaattaatgcggttcaagacaatgtagctaattatggtaatcgtttggattcggctttaagcgtggctaaagatgtttataacctaaaatccaatcaaacagagatcgtaaccacttataacgatgctaagaatttgagcgaagagatttctaaacttccctataaccaagtcaatgtaacaaacatcgttatgtcgcctaaagattctacagcgggccaataccaaatcaacccagagcagcaatccaatcttaaccaagctttagcggcgatgagcaataacccctttaaaaaagtgggcatgatcagctctcaaaacaataacggcgctttgaacgggcttggcgtgcaagtgggttataaacaattctttggcgaaagcaaaagatgggggttaaggtattatggtttctttgattacaaccacggctatatcaaatccagcttttttaattcttcttctgatatatggacttatggcggtgggagcgatttgttagtgaattttatcaacgatagcatcacaagaaagaacaacaagctttctgtgggtctttttggtggtatccaactagcagggactacatggcttaattctcaatacatgaatttaacagcgttcaataacccttacagcgcgaaagtcaatgcttccaatttccaatttttgttcaatctcggcttgaggacgaatctcgctacagctaagaaaaaagacagcgaacgttccgcgcaacatggcgttgaactgggcattaaaatccctaccattaacaccaattattattcttttctaggcactaagctagaataccgaaggctttatagcgtgtatctcaattatgtgtttgcttattaa

SEQ ID NO: 501 - DNA, 1587 bp, Helicobacter pylori J99
atgaaattaaaaaaacgaaaagttgcggctacattgctaaagcgtttgaccttgccactattgttcactacgggttcattaggggcggttacttatgaagtgcatggggattttatcaacttctccaaagtgggttttaaccgttcgcctattaaccctgttaaaggtatctatcctacagaaacttttgttaaccttacgggtaagctagaggggtctgtgcatttaggtaggggatggaccgtgaatgtaggcggtgttttgggcggacaagtttatgataacactaggtatgataggtgggcaaaggattttacccccccaagctattgggataaaacttcttgcggcactgattctttgagcctttgtatgaatgcgactaaaatgtggcaacagcaagggccaggtggtatcattgaccctaggggtattggctatatgtatatgggtgagtggaacggcttgttccctaattactatccggctaacgcctacttgcccgggcattcaaggcgctatgaagtttataaagcgaatcttacctatgacagcgacagagtccatatggtaatggggcgctttgatgttaccgagcaggagcaaatggattggatttaccaattgttccaaggtttttatgggactttcaagcttactaagaacatgaaattcttgctctttagctcttggggtcgtggtatcgctgatggtcaatggttgttccctatctatcgtgaaaagccttggggtattcataaggcgggtattatttatcgccctacaaagaatctaatgatccacccttatgtgtatctcatcccaatggtaggtacattgcccggtgctaaaatagaatacgataccaatcctgagtttagcggtagaggtataaggaataaaacgactttctatgtgttgtatgactatcgttggaataacgctgaatacggccgttacgcacccgctcgttataacacttgggatccgttcttggataatggtaagtggcgtggcttgcaaggtcctggtggtgcgacgctctatttgcaccaccacatagacattaacaactactttgtggttggtggtgcttacctcaacatcggtaaccctaacatgaacttaggtacttggggtaaccctgtggctcttgatggtatcgaacaatgggtcggtggcatctacagcttaggctttgcggggattgacaacattaccgatgctgatgcgttcactgagtatgttaaaggtggaggtaagcatggtaagttcagttggagcgtttatcagcgcttcactaccgcaccaagggctttggaatatggtattggtatgtatctagactatcagttcagcaagcatgttaaagcgggtctcaaactcgtgtggttagagttccaaatccgtgcgggttacaaccctggaaccggtttccttgggccaaacggtcagccgctcaacttgaataatggtttgtttgaatcttcggcgttcgcgcaaggccctcaaaacatgggtggtatcgcaaaaagcattactcaagacagaagccatttgatgacacacatcagttatagtttctaa

SEQ ID NO: 502 - DNA, 1764 bp, Helicobacter pylori J99
atgaaaaacttttccccactctattgtcttaaaaagctcaaaaaacgccatttaatcgctctgagtctgcccttgctttcttatgcgaatggctttaaaatccaagagcaaagcttgaatggcacggctttaggctcggcgtatgtcgctggggctaggggtgctgacgcttctttttacaacccggctaacatgggctttactaacgattggggcgaaaacagaagcgaatttgaaatgaccaccaccgtgatcaatatcccggcctttagctttaaagtccctacgaccaatcaaggcttatattcggtaacaagtttagaaattgataaaagccaacaaaatattttaggcatcatcaacactatagggttaggcaatatccttaaagcgcttggcaatacggccgctaccaatggcttatcacaagctatcaatcgtgttcaagggcttatgaacttaaccaatcaaaaagtcgtaaccctcgcttcaaaacctgacactcaaatcgtgaatggctggacaggcacgactaattttgttttacctaaattcttttataaaacgcgcacgcataacggcttcacttttggggggagttttaccgctcctagtgggttgggtatgaaatggaatggtaaggggggggaatttttgcatgacgtgtttatcatgatggtagagcttgcccctagcatgagttatactattaataaacgcttttctgtgggtgtgggtttaagggggctttatgcgaccgggagctttaataacaccgtttatgtgcctttagagggcgcttcagttttgagcgcggagcaaatcttaaacttacccaacaatgtttttgccgatcaagtgccaagtaacatgatgactttattaggcaatattggctaccaaccagcgcttaattgccaaaaagccggtggggacatgagtgatcagagctgtcaagagttttacaacggcttgaaaaaaatcatgggttatagcggtttaatcaaagcgagcgcgaatctttatggcacgactcaagtcgtgcaaaaatctaacggacaaggcgtatcgggggggtatagagtgggttcgagtttgcgtgtgtttgatcatggcatgttttctgtggtgtataattcttcagttacctttaacatgaaaggcggtttggtggctatcacagagcttggcccttctttagggagcgttttgactaaaggcagcttgaatatcaatgtttcactcccccaaactttaagcttagcctacgcccaccaattttttaaagatcgcctaagggttgaaggggtgtttgagcgcactttttggagtcaagggaataaatttttagtcacccctgattttgcgaacgccacttacaagggcttgagcgggacggtggcttccttggactctgaaacgcttaaaaaaatggtaggcctagcgaattttaaaagcgtgatgaacatgggggctggctggagggacaccaacacctttagattaggggtaacttacatgggtaaaagcttgcgtttaatgggcgctattgattatgatcaagccccaagcccccaagacgcgataggcattccggactctaatggctataccgtggcttttgggactaaatacaattttaggggctttgatttgggcgtagcggggagtttcacttttaagagcaaccgctccagtttgtatcaatccccaactattgggcaattgagaatctttagcgcctctttaggctatcgctggtaa

SEQ ID NO: 503 - DNA, 1533 bp, Helicobacter pylori J99
atggcttttcaggtcaatacaaatatcaatgcgatgaatgcgcatgtgcaatccgcactcactcaaaacgcacttaaaacttcattggagcgattgagttcaggtttaaggatcaataaagcggctgatgacgcatcaggcatgacggtggcggattctttgcgttcgcaagcgagcagtttgggtcaagcgattgccaacacgaatgacggcatggggattatccaggttgcggataaggctatggatgagcaattaaaaatcttagacaccgttaaggttaaagcgactcaagcggctcaagatgggcaaactacggaatctcgtaaagcgattcaatctgacatcgttcgtttgattcaaggtttggataatatcggtaacacaacgacttataacgggcaagcgttattgtctggtcaattcactaacaaagaattccaagtaggggcttattctaaccaaagcattaaggcttctatcggctctaccacttccgataaaatcggtcaggttcgtatcgctacaggcgcgttaatcacggcttctggggatattagcttgacttttaaacaagtggatggcgtgaatgatgtaactttagagagcgtaaaagtttctagttcagcaggcacagggatcggcgtgttagcagaagtgatcaataaaaactctaaccgaacaggggttaaagcttatgcgagcgttatcaccacgagcgatgtggcggtccagtcaggaagtttgagtaatttaaccttaaatgggattcatttgggtaatatcgcagatattaagaaaaacgactcagacggaaggttagtcgcagcgatcaatgcggtcacttcagaaaccggtgtggaagcttatacggatcaaaaagggcgcttgaatttgcgcagtatagatggtcgtgggattgaaatcaaaaccgacagcgtcagtaacgggcctagcgctttaacgatggtcaatggcggtcaggatttaacaaaaggctctactaactacggaaggctttctctcacacgattagacgctaagagcatcaatgtcgtttcggcttctgactcacagcatttaggcttcacggcgattggttttggggaatctcaagtggcagaaaccacggtgaatttgcgcgatgttactgggaattttaacgctaatgtcaaatcagccagtggcgcgaactataacgccgtgatcgctagcggtaaccaaagcttgggatctggggttacaaccttaagaggcgcgatggtggtgattgacattgccgaatcagcgatgaaaatgttggataaagtccgctctgacttaggttctgtgcaaaatcaaatgattagcactgtgaataacatcagcatcactcaagtgaatgttaaagcggctgaatctcaaatcagggatgtggatttcgctgaagagagcgcgaatttcaacaaaaacaacattttggcgcaatcaggcagctatgcgatgagtcaagccaataccgttcaacaaaatatcttaaggcttttaacttag

SEQ ID NO: 504 - DNA, 1113 bp, Helicobacter pylori J99
atggcaggcacacaagctatatatgaatcatcttctgcaggattcttatcgcaagtctcctcaatcatctcaagcacaagtggtgtcgcagggccatttgcaggaatagtagcgggcgctatgacagcagcgattattcctattgttgtgggatttactaatccgcaaatgaccgctatcatgacccaatacaatcaaagcatcgctgaagctgtaagcgtgcctatgaaagccgctaaccaacaatacaaccaattgtatcaaggttttaacgatcaaagcatggctgtggggaacaatatcttaaatatcagcaaattaacaggggaatttaacgcgcaaggcaacacgcaaagcgcgcaaattagtgctgtcaatagtcagattgcaagcattttagcgagtaacactacccctaaaaatcctagcgctattgaagcttatgcgacgaatcaaatcgctgttcctagcgtgccaacaacggttgaaatgatgagcggtatattaggcaatattacaagcgcagcaccaaaatacgccctagctctacaagagcaactgcgttctcaagcaagcaacagctcaatgaatgatacagccgattcccttgatagctgtaccgctttaggcgcacttgttggctcatcaaaagtgtttttcagttgcatgcaaatttctatgactcctatgagtgtttctatgcccactgtttatgccaaataccaagcggttgccactaaagccctaacttcaggcgttaatcctatgaccactcctgcatgccctattggggacaaggttcttgccgtttattgctatgctgaaaaagtagcagaaattttgagagaatactatatagaatttgtgaaaaacaataccaatttgttgcagaacgcttctcaaatgatacttaatcaatcaggattagctactagcacctatgacactcaagcgatttctaacataagctcgctatataattacaatatagtagcgaataaatcttttttgaaatcgcatttgacttatcttgattacatcaaagacaagcttaaggggcaaaaagatagctacttaacagaaagggtgcagactaaaataatcgtgaagtga

SEQ ID NO: 505 - DNA, 3504 bp, Helicobacter pylori J99
atgactaacgaagccattaaccaacaaccacaaaccgaagcggcttttaacccgcagcaatttatcaataatcttcaagtggcttttattaaagttgataatgttgtcgcttcatttgatcctaatcaaaaaccaatcgttgataagaatgatagggataataggcaagcttttgagaaaatctcgcagctaagggaggaattcgctaataaagcgatcaaaaatcctaccaaaaagaatcagtatttttcaagctttatcagtaagagcaatgatttaatcgacaaagacaatctcattgatacaggttcttccataaagagctttcagaaatttgggactcagcgttaccaaatttttatgaattgggtgtcccatcaaaacgatccgtctaaaatcaacacccaaaaaatccgaggttttatggaaaatatcatacaaccccctatctctgatgataaagagaaagcggagtttttgaggtctgccaaacaagcttttgcaggaattatcataggaaaccaaatccgatcggatcaaaaattcatgggcgtgtttgatgaatctttgaaagagaggcaagaagcagaaaaaaatggagagcctaatggagatcctactggtggggattggcttgatatttttttatcatttgtgtttaacaaaaaacaatcttccgatctcaaagaaacgctcaatcaagaaccagttcctcatgtccaaccagatgtagccactaccaccactgacatacaaagcttaccgcctgaagctagggatttgcttgatgaaaggggtaatttttctaaattcactcttggcgatatgaacatgttagatgttgagggagtcgctgacattgatcctaattacaagttcaaccaattattgatccacaataacgctctgtcttctgtgttaatggggagtcataatggcatagaacctgaaaaagtttcattgttgtatggaaacaatggtggtcctgaagctaggcatgattggaacgccaccgttggttataaaaaccaacgaggcgacaatgtggctacactcattaatgtgcatatgaaaaatggcagtgggttagtcatagcaggtggtgagaaagggattaacaaccctagtttttatctctacaaagaagaccaactcacaggctcacaacgagcattgagtcaagaagagatccaaaacaaagtggatttcatggaatttcttgcacaaaataatgctaaattagacaacttgagcaagaaagagaaagaaaaattccaaaatgagattgaagattttcaaaaagactctaaggcttatttagacgccctagggaatgatcacattgcttttgtttctaaaaaagacaaaaaacatttagctttagttgctgagtttggtaatggggaattgagctacactctcaaagattatgggaaaaaagcagataaagctttagatagggaggcaaaaaccactcttcaaggtagcctaaaacatgatggcgtgatgtttgttgattattctaatttcaaatacaccaacgcctccaagagtcctgataagggtgtgggtgctacgaatggcgtttcccatttagaagcaggctttagcaaggtagctgtctttaatttgcctaatttaaataatctcgctatcactagtgtcgtaaggcaggatttagaggataaactaatcgctaaaggattgtccccacaagaagctaataagcttgtcaaagattttttgagcagcaacaaagaattggttggaaaagctttaaacttcaataaagctgtagctgaagctaaaaacacaggcaactatgacgaggtgaaacaagctcagaaagatcttgaaaaatctctaaagaaacgagagcgtttggagaaagatgtagcgaaaaatttggagagcaaaagcggcaacaaaaataaaatggaagcaaaatctcaagctaacagccaaaaagatgagatttttgcgttgatcaataaagaggctaatagggatgcaagagcaatcgcttacgctcagaatcttaaaggcatcaaaagggaattgtctgataaacttgaaaatatcaacaaggatttgaaagactttagtaaatcttttgatgaattcaaaaatggcaaaaataaggatttcagcaaggcagaagaaacactaaaagcccttaaaggctcggtgaaagatttaggtatcaatccagaatggatttcaaaagttgaaaaccttaatgcagctttgaatgaattcaaaaatggcaaaaataaggatttcagcaaggtaacgcaagcaaaaagcgaccttgaaaattccattaaagatgtgatcatcaatcaaaagataacggataaagttgataatctcaatcaagcggtatcagtggctaaagcaacgggtgatttcagtggggtagagcaagcgttagccgatctcaaaaatttctcaaaggagcaattggctcaacaagctcaaaaaaatgaagatttcaatactggaaaaaattctgcactataccaatccgttaagaatggtgtaaacggaaccctagtcggtaatgggttatctaaagcagaagccacaactctttctaaaaacttttcggacatcaagaaagagttgaatgcaaaacttggaaatttcaataacaataacaataatggactcgaaaacagcacagaacccatttatactcaagttgctaaaaaggtaaaagcaaaaattgaccgactcgatcaaatagcaagtggtttgggtgatgtagggcaagcagcgagcttccttttgaaaaggcatgataaagttgatgatctcagtaaggtagggctttcagctaaccatgaacccatttacgctacgattgatgatctcggcggacctttccctttgaaaaggcatgataaagttgatgatctcagtaaggtagggctttcaagggagcaaaaattgactcagaaaattgacaatctcaaccaggcggtatcagaagctaaagcaagtcattttgacaacctagatcaaatgatagacaagctcaaagattctacaaaaaagaatgttgtgaatctatatgttgaaagtgcaaaaaaagtgcctactagtttgtcagcgaaattggacaattacgctactaacagccacacacgcattaatagcaatgtcaaaaatggaacaatcaatgaaaaagcgaccggcatgctaacgcaaaaaaattctgagtggctcaagctcgtgaatgataagatagttgcgcataatgtgggaagtgctcctttgtcagcgtatgataaaattggattcaaccaaaagaatatgaaagattattctgattcgttcaagttttccaccaggttgagcaatgccgtaaaagacattaagtctggctttgtgcaatttttaaccaatatattttctatgggatcttacagcttgatgaaagcaagtgtggaacatggagtcaaaaatactaatacaaaaggtggtttccaaaaatcttaa

SEQ ID NO: 506 - DNA, 783 bp, Helicobacter pylori J99
atgaaaacaaatggtcattttaaggattttgcatggaaaaaatgctttttaggcgcgagcgtggtggctttattagtggggtgtagcccgcatattattgaaaccaatgaagttgctttgaaattgaattaccatccagctagcgagaaagttcaagcgttagatgaaaagattttacttttaaggccagctttccaatacagcgataatattgctaaagagtatgaaaacaaattcaagaatcaaaccacgcttaaagttgaagagatcttgcaaaatcagggctataaggttattaatgtggatagcagcgataaagacgatttttcttttgcgcaaaaaaaagaagggtatttggctgtcgctatgaatggcgaaattgttttacgccccgatcctaaaaggaccatacagaaaaaatcagaacccgggttattattctccactggtttggataaaatggaaggggttttaatcccggctgggtttgtcaaggttaccatactagagcctatgagtggggaatctttggattcttttacgatggatttgagcgagttggacatccaagaaaaattcttaaaaaccacccattcaagccatagcggagggttagttagcactatggttaaggggacggataattctaatgacgcaattaagagcgctttgaataagatttttgcaagtatcatgcaagaaatggataagaaactcactcaaaggaatttagaatcttatcaaaaagacgccaaggaattaaaaaacaagagaaaccgataa

SEQ ID NO: 507 - DNA, 3657 bp, Mycoplasma pneumoniae
atgaaatcgaagctaaagttaaaacgttatttactgtttttaccacttttaccgctagggacgttgtcactagccaacacctacctcctccaagaccacaacaccctcaccccctacacgccctttacgacaccgctcaatggggggctggatgtcgtgcgcgccgcccatttacacccctcatacgaactcgtggactgaaagcgggtgggggataccaagttggtggcgctggtccgctcagcgttggtcagggtgaaattccaggacacaacgagttcggatcaaagtaataccaaccaaaatgccttgagttttgatacccaagaatcacagaaggcacttaatggctcgcagagtggatcttctgacacttccgggtctaactcccaagacttcgccagctatgtcctcatctttaaagccgcgcccagggccacgtgggtgtttgaacgcaagattaagttggcgttgccctacgttaagcaggaaagtcagggttccggcgatcaaggttccaatggtaagggctccctctacaaaaccctccaagacctcctcgtcgaacaacccgtgaccccttacaccccgaatgcggggttagcccgggtgaatggggttgctcaggatacggttcattttggttcgggtcaagaatcgagttggaattcccaacgttcccaaaaaggccttaaaaacaaccccggacccaaagccgtcaccggctttaagctcgataagggccgcgcgtaccggaagctgaatgaaagttgaccggtgtatgaacccctggattcgaccaaggaggggaaggggaaggatgagagctcttggaaaaattcggaaaaaacaacagcggaaaatgatgccccgttggtggggatggttggaagtggtgcggctggaagtgcttctagtttacaaggcaatggctcgaacagttcggggttaaaatcgctcttgagatcagcacctgtcagtgttccaccaagcagtacaagtaatcaaactttaagcttatctaaccccgctcctgtgggcccacaagcggttgtaagccaacccgcggggggtgctacggcagcagtgtccgtcaatcgcacagcgagtgacaccgccacctttagcaagtacctcaacaccgcccaggccttgcaccagatgggggtgattgttccggggttggaaaaatgaggtggtaacaacggtacgggtgtagtggctagccgacaggatgctacttccactaacctgccccatgcggcaggtgcttcccaaacgggtttgggaactggttcgccccgcgaaccagctttaaccgcaacgtcacagcgtgccgtcacggtggttgctggcccccttcgtgcgggcaatagcagtgaaactgatgccctaccgaatgtcatcacccagctctatcatacttcaaccgcccaactcgcttacttaaatggccagatcgttgtgatgggttccgaccgggtaccgagtctttggtattgagttgtcggggaggaccaggaatcgggcaaagcgacctgatgagcgaaaaccgagctcaactggggcaccgacaagcagaagcagtttgtcgaaaaccagttggggtttaaagatgactcaaattcggattccaaaaattcgaatttgaaggcccaaggcctcacccaacccgcctacctcatcgccggtcttgacgttgtggccgaccacctcgtctttgcggcctttaaagcgggcgcggtggggtatgatatgacgactgattcgagcgcttcgacctacaaccaagcactcgcctggtcgaccacggccgggttggacagtgatggggggtacaaggccttggtggaaaacacggccgggctcaacggcccgattaatggcttgtttaccctgctcgacacctttgcgtatgtgacccccgtgagtgggatgaaaggggggagtcagaataatgaagaagtgcaaacgacttacccggtcaagtccgaccaaaaggccaccgccaaaattgcctccttaattaatgccagcccactcaacagttatggggatgatggggtgaccgtgtttgatgccctgggccttaactttaactttaagttgaacgaggagcgcttgccatcgcgcaccgaccaactgcttgtgtatgggattgtaaacgaaagtgaactgaagtccgcacgggaaaatgcccagtcgacctccgatgataattcaaacaccaaagtcaagtgaaccaacaccgcctcgcactacctccccgtgccgtattactacagtgccaatttccccgaagcgggtaacagaaggcgagcggagcagcggaatggggtgaagattagcaccttggaatcgcaagccactgatggctttgccaactcgttacttaactttggtaccggtcttaaagccggtgttgacccagctccagtagcacggggtcataaaccgaactatagtgcagtactactagtgcgtggtggcgttgtaaggttaaactttaaccccgatactgataaactgttggattctactgacaaaaacagtgaacctatctccttctcctataccccatttgggtctgctgaaagtgccgtagacctcaccacgttgaaggatgtgacctatattgctgaaagtggtctgtggttctatacctttgacaatggtgaaaaaccaacgtacgatggtaaacaacaacaggtcaaaaaccgcaagggttatgctgtgattaccgtatcacgtaccggaattgaatttaacgaggacgctaataccacaaccttaagccaagccccagctgctttggctgtccaaaacgggattgcttccagtcaggacgacctcacaggcatcctaccgttatccgatgagttctccgctgtgattaccaaggatcaaacatggaccggtaaggttgatatctataagaacaccaacgggttgtttgaaaaggatgatcagctatcggaaaacgtgaagaggcgtgacaacggtttggtccctatttacaacgaaggtatcgtcgatatttggggcagagtggattttgctgccaacagtgttttgcaagcgcgtaacctcactgataaaacggttgatgaggtgatcaataaccccgatatcctccaaagcttctttaagtttaccccagcctttgataaccaaagagcaatgctagtgggggaaaagacatcggatactaccttaacggttaaaccgaagattgagtacttggatggtaacttctatggtgaggattccaagattgctggaattccgctcaacattgatttcccttcccggatttttgctggctttgctgctttaccgtcctgggtcattccggtatcagtcggttcatcggtgggcattctcttaatcctgctcatcttaggccttggtattggaattccaatgtataaggtccgcaagcttcaagactccagctttgttgatgtgtttaaaaaggtggatacgttgacaaccgctgtgggtagcgtgtacaagaagattatcacccaaacgagtgtgatcaaaaaagctcctagtgcgttgaaagctgctaataacgctgctcctaaagcaccagttaaaccagctgctccaacagctccaagaccaccagtccaaccacctaaaaaggcttaa

SEQ ID NO: 508 - DNA, 4884 bp, Mycoplasma pneumoniae
atgcaccaaaccaaaaaaactgccttgtccaagtccacttggattctcatcctcaccgccaccgcctccctcgcgacgggactcaccgtagtgggacacttcacaagtaccaccacgacgctcaagcgccagcaatttagctacacccgccctgacgaggtcgcgctgcgccacaccaatgccatcaacccgcgcttaaccccgtgaacgtatcgtaacacgagcttttcctccctccccctcacgggtgaaaatcccggggcgtgggccttagtgcgcgacaacagcgctaagggcatcactgccggcagtggcagtcaacaaaccacgtatgatcccacccgaaccgaagcggctttgaccgcatcaaccacctttgcgttacgccggtatgacctcgccgggcgcgccttatacgacctcgatttttcgaagttaaacccgcaaacgcccacgcgcgaccaaaccgggcagatcacctttaacccctttggcggctttggtttgagtggggctgcaccccaacagtgaaacgaggtcaaaaacaaggtccccgtcgaggtggcgcaagacccctccaatccctaccggtttgccgttttactcgtgccgcgcagcgtggtgtactatgagcagttgcaaagggggttgggcttaccacagcagcgaaccgagagtggtcaaaatacttccaccaccggggcaatgtttggcttgaaggtgaagaacgccgaggcggacaccgcgaagagcaatgaaaaactccagggcgctgaggccactggttcttcaaccacatctggatctggccaatccacccaacgtgggggttcgtcaggggacaccaaagtcaaggctttaaaaatagaggtgaaaaagaaatcggactcggaggacaatggtcagctgcagttagaaaaaaatgatctcgccaacgctcccattaagcggagcgaggagtcgggtcagtccgtccaactcaaggcggacgattttggtactgccctttccagttcgggatcaggcggcaactccaatcccggttcccccaccccctgaaggccgtggcttgcgactgagcaaattcacaaggacctccccaaatgatccgcctcgatcctgattctgtacgatgcgccttatgcgcgcaaccgtaccgccattgaccgcgttgatcacttggatcccaaggccatgaccgcgaactatccgcccagttgaagaacgcccaagtgaaaccaccacggtttgtgggactgaaaggcgcgcgatgttttgctccaaaccaccgggttcttcaacccgcgccgccaccccgagtggtttgatggcgggcagacggtcgcggataacgaaaagaccgggtttgatgtggataactctgaaaacaccaagcagggctttcaaaaggaagctgactccgacaagtcggccccgatcgccctcccgtttgaagcgtacttcgccaacattggcaacctcacctggttcgggcaagcgcttttggtgtttggtggcaatggccatgttaccaagtcggcccacaccgcgcctttgagtataggtgtctttagggtgcgctataatgcaactggtaccagtgctactgtaactggttgaccatatgccttactgttctcaggcatggtcaacaaacaaactgacgggttaaaggatctaccctttaacaataaccgctggtttgaatatgtaccacggatggcagttgctggcgctaagttcgttggtagggaactcgttttagcgggtaccattaccatgggtgataccgctaccgtacctcgcttactgtacgatgaacttgaaagcaacctgaacttagtagcgcaaggccaaggtcttttacgcgaagacttgcaactcttcacaccctacggatgagccaatcgtccggatttaccaatcggggcttgaagtagtagtagtagtagtagtcacaacgcaccctactacttccacaataaccccgattgacaagaccgtccaatccaaaatgtggttgatgcctttattaagccctgagaggacaagaacggtaaggatgatgccaaatacatctacccttaccgttacagtggcatgtgagcttgacaggtatacaactggtccaataagctcactgaccaaccattaagtgctgactttgtcaatgagaatgcttaccaaccaaactccttgtttgctgctattctcaatccggaattgttagcagctcttcccgacaaggttaaatacggtaaggaaaacgagtttgctgctaacgagtacgagcgctttaaccagaagttaacggtagctcctacccaaggaacaaactgatcccacttctcccccacgctttcccgtttctccaccgggttcaaccttgtggggtcggtgctcgaccaggtgttggattatgtgccctggattgggaatgggtacaggtatggcaataaccaccggggcgtggatgatataaccgcgcctcaaaccagcgcggggtcgtccagcggaattagtacgaacacaagtggttcgcgttcctttctcccgacgttttccaacatcggcgtcggcctcaaagcgaatgtccaagccaccctcgggggcagtcagacgatgattacaggcggttcgcctcgaagaaccctcgaccaagccaacctccagctctgaacgggggcggggtgaaggaatgataaggcttcaagtggacaaagtgacgaaaaccacaccaagttcacgagcgctacggggatggaccagcagggacaatcaggtacctccgcggggaatcccgactcgttaaagcaggataatattagtaagagtggggatagtttaaccacgcaggacggcaatgcgatcgatcaacaagaggccaccaactacaccaacctcccccccaacctcacccccaccgctgattgaccgaacgcgctgtcattcaccaacaagaacaacgcgcagcgcgcccagctcttcctccgcggcttgttgggcagcatcccggtgttggtgaatcgaagtgggtccgattccaacaaattccaagccaccgaccaaaaatggtcctacaccgacttacattcggaccaaaccaaactgaacctccccgcttacggtgaggtgaatgggttgttgaatccggcgttggtggaaacctattttgggaacacgcgagcgggtggttcggggtccaacacgaccagttcacccggtatcggttttaaaattcccgaacaaaataatgattccaaagccaccctgatcacccccgggttggcttgaacgccccaggacgtcggtaacctcgttgtcagtggcaccacggtgagcttccagctcggcgggtggctggtcaccttcacggactttgtcaaaccccgcgcgggttacctcggtctccagttaacgggcttggatgcaagtgatgcgacgcagcgcgccctcatttgggccccccggccctgagcggcctttcgtggcagttgggtcaaccggttgggccgcgtggagagtgtgtgggatttgaagggggtgtgggcggatcaagctcagtccgactcgcaaggatctaccaccaccgcaacaaggaacgccttaccggagcacccgaatgctttggcctttcaggtgagtgtggtggaagcgagtgcttacaagccaaacacgagctccggccaaacccaatccactaacagttccccctacctgcacttggtgaagcctaagaaagttacccaatccgacaagttagacgacgatcttaaaaacctgttggaccccaaccaggttcgcaccaagctgcgccaaagctttggtacagaccattccacccagccccagccccaatcgctcaaaacaacgacaccggtatttgggacgagtagtggtaacctcagtagtgtgcttagtggtgggggtgctggagggggttcttcaggctcaggtcaatctggcgtggatctctcccccgttgaaaaagtgagtgggtggcttgtggggcagttaccaagcacgagtgacggaaacacctcctccaccaacaacctcgcgcctaatactaatacggggaatgatgtggtgggggttggtcgactttctgaaagcaacgccgcaaagatgaatgacgatgttgatggtattgtacgcaccccactcgctgaactgttagatggggaaggacaaacagctgacactggtccacaaagcgtgaagttcaagtctcctgaccaaattgacttcaaccgcttgtttacccacccagtcaccgatctgtttgatccggtaactatgttggtgtatgaccagtacataccgctgtttattgatatcccagcaagtgtgaaccctaaaatggttcgtttaaaggtcttgagctttgacaccaacgaacagagcttaggtctccgcttagagttctttaaacctgatcaagatacccaaccaaacaacaacgttcaggtcaatccgaataacggtgacttcttaccactgttaacggcctccagtcaaggtccccaaaccttgtttagtccgtttaaccagtgacctgattacgtgttgccgttagcgatcactgtacctattgttgtgattgtgctcagtgttaccttaggacttgccattggaatcccaatgcacaagaacaaacaggccttgaaggctgggtttgcgctatcaaaccaaaaggttgatgtgttgaccaaagcggttggtagtgtctttaaggaaatcattaaccgcacaggtatcagtcaagcgccaaaacgcttgaaacaaaccagtgcggctaaaccaggagcaccccgcccaccagtaccaccaaagccaggggctcctaagccaccagtgcaaccacctaaaaaacccgcttag

SEQ ID NO: 509 - DNA, 3903 bp, Mycoplasma pneumoniae
atgggttataagttaaagcgatgacctttagttgcgtttacatttaccggaattggcctaggggtggtgctagcggcgtgttctgcactcaatacctccaatctgtttccccgtcaaaaccgctccaagcagttgattgggtttaccgaaaacaacatcattaaacctgaagctgtactaaaagccgctttagctgaggacaatggtacggaaaccattttaagggttaactttggtgaagcgttaaagagttggtaccaaaacaataaggatcgcaacattgctacccgtttaactatctttagtgaaaacgtggaggatgaacatgataacctgttggaccaaaaacaacaggccgaaccgattaattgaccaatagagctccaaaaggaatacgaccagtggggtgggagtgaaagttcctgaaaggccttaaagttatacgaccgtttaatagccgacttccaatcacttatctttagcaacattgttgctaatgtgcagttgactgatggtagtgatcagtttaaacccactaccaaagataacctcgacagtactagcaacaaaatcaagtttgttaattccaaaccaaatgatcctaacggggagttctttgctaacctccaggcttatctatttgcccagtgagtagtggaggaaaaccccctccccctcacccaagccttcttcgcgtaccaagcacccaaggacgggctcgacagcttatacgaccaagccgcgattggtagtgccttacagttgggctatgccttccccgcgtttcgcgagcccaataatggacaaagccaaggtaaaaccaccttcgaccccacccccaacagtgcccaaaacttcggggatttcattaaggcggtgtttccggagcagaagaatggtcaaacccaacaatccaatacatcctcccgcaccgggttgtttgactggcaaaccaagtgaaacaccaatggcgctgccaataagctcttggtgaccaagtccaacctgcgcggggcctttaagggcgtggggttagctacggccattattgaccagtacgagtacctggtgggtggaagtaaaacgagttcgttgcccgaggtcaaggtagattcgaataagtccaaccaaaatccgctggatagtttttttatggaggggaaggatgcggtggcgattagatccatagtttcgcgtgcgaaaattgccatgaccgaccaaacccccgggtttaaggtcaacccggcgtttgtcaaggtgaagcagagtcagcagaacgataccttttaccaaaaccagcgcaaactgagcggcgggcaaagtggggataataactcccagggtaaacaccactacctccaagacgcggtgcggttgacgagtagtcaagcaatggcggcagcttctactggggcagattctagtagtggtaccaatgttggtggtagctccgggggcaactctgttttaattccgctcccaaggagtgccgcccttacccacacccagcaacaagttcaacaaaccacctccacactccaaacccctgtttacgcccgtggtgacgatggtacatacgccctggcaattgacggtggtgattattttttggcgaacaacaaacgcgatttcaccaaacaagccgacatcttgctgtaccgctatttacaagctaagagtaataactttaaggaaaacggcgtcgagtttagtttgaacttactggaatctggcagcctgttccaaacgtgagcacaaacggggttaaccgcgaagttgtacggtgctttggtggcgatgatgggttcgggtcaggggacccaagttaagggcagtgtgcaggggagtagccgagcagcttctgttagcgttcaaactacccagcaaaacagacagcaatcgactgatacccaagaatcggaagtggttaagttagccaagtccctgctgaaatcaagtgcggatttggccaaacccttcactgataaccccacctttaaaaaggccttaaccgacatccaatccgagtacaaggattatttggctgctgcggggaagttaagtgagtttaagaaagatttgggggaggtgagtggcttacagcaagctattattgaccgcgctgataagtacattcaactagaaaaacaagcccaaaagagtgcgattggcttgggccaaccgctcccttaccaacgcgctagtgatggtagttaccccgctttagagaagttctttattccggaagatagtgcagcagatggaaaagtaaaagcatctgaatcaggatctgccgctttagtaacactaaagacaacagatagtcaaaaaagcacaaacaccgttaaacaaccggacatcaaaccgacccgggaaaacaacgacaaaaagttaaagcagttaactagtgatgtagaaactaaagcatctagtttaatcaccaaatgaggtgcaacaccccaaattggtagtcagttctccgaaattgtttcgctcaagagtaaggacaataagccccagaccaacatgatcttggccttattgtctgatgttgggattaagtgaaccaagattctcaattcctttaaggagtggttctttactaataccaacgactttaagaacaattacgattctgaaaagaaagaacttaaaggcaatgagtacaaggactttaacgacctcgttaaacaaaccttgtacttacgttcctgacaacgactcacttccaaggaaaagtttggttattacaaggagttgggtagtgtaaaagcacaagcagctcaatcaggaatggtttcactttcaagtagcgcagcagttgcaaatgctgtagcttcaagtggcatgcaaaaatctggtgatcaaaccctcttggaactcggtaaaaaagcgtttgaaagtgaactggaagcatctagtagtgatgggcagtacaagtacctgcgcttcttgtccaccttaatgtgactagttaaggatggggcgaagaactataagcgcttgctccaacaagcgattaccgtgggtacccgtgcctttgtgtcgtgaacggtgagctatgatgatacggctacggcatcagcagccgcagcaaaagcgcaagtagcagtattaaagacagctcaggcaacaaatactcaaagcgacaaccccttcaataagtttgtccaaaaccccgattatgtccagggttcggaaaccaactgatttaacgataagagtacgccaattaaacccgattcgttactggaaagcgaaagcacttacaactttaccgcggaaccgtttgatgataagacgaaaagtcaaaagaggtctactggtggtaccactaacgaaaaacacttctttggctttaacggtttaacgattaactcgccccaaagtgtgtcgactgctagtgccggactcacggaacaaatctttaacaactttggtcagttagtaacaagtagtgacaaatccggggccttgagccagtacaaggataaagcaaccctgaaacgcttaatccaaaacactaattccgatgccgagctcaatgcctttggtgaagtgttgcaccgtgcagttaatgtcgataccagtaacttaggacgttttaactccagtggggaaccgttgattagctttgacaacaagaagaagttcttggttgatgtagtggacaaactggatgatgtttactttaacaagttcgaaggttatgttggccaaaccaaggtgaagatgtctgattcaagtagtagttcccaaggtacgaagactataagaaagccaaagccgcaccactcaccaaggactcgagtgtcaagactttgagctatgtcattcagattaccaacgaggacgttaacaaaatttctgctagttgaaaaactgataagaacagtgctttag

SEQ ID NO: 510 - DNA, 453 bp, Mycoplasma pneumoniae
atgaaaaaacttctaataaaaccccagttttgattcttaacccttggtggctttatctcttcaagtgttattttagttgcctgtgctaccccttccaattcagcactccaaactgtttttaaagcacgttcgaaccagttcttcaacggggaacagggtagtttacaaaacgctttagccactgctttaaaagatccagaggccaacaaacagtttgtcgctgctccccttttaaaggcattgacagcttggtatgaaaataaccaagacaaacaggtcacccagttctttaaagacaccaaaaagagtgttgatgagcaatacaaccaagccgtagataaggtggtatcggctagccgaaacaaaaacctctttgtccaacaagacttgctggatagcgccgggggggttagaaacttgaaaagcccagaagttgtttgaacagctcattaa

SEQ ID NO: 511 - DNA, 2181 bp, Mycoplasma pneumoniae
atgcaacagcaaggagaaactaaagatcaatataacacttttggcctgagacttgtgcgtaacagtgttggcgtatcagttttaggacttgatggttttgttaaattcataaaaggcggtagcggaggtagcaatggcggttctagtagtgccaaaaagattgataaagaagagcaaaagaaattcttaaagttccgtgcttttcaagccaaaattggcacattttataacactaactttgcctttagttttcccctaaacgaaactttaaaaggttggtttgacaaacaccgcggattgatcttagcgaacgccttagttaaagttactttagacacaaaggaaaaagcaagtaaggccttagtggatgcttttagttcttataaaaactgattgagtgaatacaccccggttggtttagctaccaccatgattagcttttattttgaccaaatgaaagctctcaacaataagctgttagaacgagtacggagcttaaaccaaaatgttaaccaagccaatcctaccccttggttaaatgggttatcggctaaactaccttacgttaacactaacggtaattacgaaaagttaaacaactactttacctttttaattaccaaagttttgtgacctaaggtgggcactgaggatactaatgtcagtgaagaaaaaagcaaactcaaaactaaaactgaagatgttaacaagattagggaaaagattttgaacaacatcgacagtaagctcaaaacttttgtccaaaaactcaaacctaccttagcaccccgaccagcttacagtaacgtaatcttgttaaacattaacaatgataaggtgtggtctgctggcgctaattgaagtttggcagttttactagatccgaaaaaggttaacccgctttcgtttatgttgctcaaacaaatgtttgatcaaaacagtttgtttaaaaaagcaaagactttattcgaaaacattcaaaataaagcaaaaactagtggaagtggtaaaagtggtacaaccaccaacgatgatgccgatgctttgagcaaagtcattggcaactattactacaacacttgagctaagctaaccgataaatcaatttatggcaaccttaaggatgacaaatttgatgatctctttaaattggcttttgacagtagtattaacgaaaagtcctttaatgtagattataaggcagtgattgaacactaccgctttatctataccttagagtggttggtagacaaaaacctaaagaacttcaaggatttattaaaggcaaacctcaagtttggtgaaattgcttttattgcttacaagaatactgaaacgcagaacttctctaacccgcaaggtatattcggttcttactttaattacgaaaacgaaacgaatgcggctaagagtgctacgcaaattatagaccccaacagtttcttctataaaaccaccactaaaccagaagcgaaaaccactcaaagtgctaatacagctgtgatggttcaaaatacgcagatgaacaatcagcaaactaacagttatggctttactggtttgagtaccagtagtggttcgatgttaggtgctgctacccagcaagccattttggatcaaataaccaaaacttccttgcaacagtatggttctcaagctgacctgaaaaagatcattggcgaaactaaaaatcaattattattagaccgaattgccaaccaactaatagccttaaaaccgaatacaagtggcaacagtggtacccaaaaaacaattgctgcatacttccaaacagatgcggttggcaatcctactttggactttaaagcgaagcaaaaactcttattggatgttttagatcaatacaaagatttctttggtaataatgcacaagcagttcaaagagattctggtaagagtggaactggcaactatttaacctataccgacggtagtgataagatcacttatttgcagttttcctataaagatattgacggtttaagtttgagtagttcaaacggaactagcagcaaatttgccagtgatgttgtagcagcgcttttattattccaggcagcctataaaggtactcaacaactggctttaagttccatcaataaaccacaattaccaattggcgataaacgcataaaaacagggatcgatttactgaaatag

SEQ ID NO: 512 - DNA, 714 bp, Mycoplasma pneumoniae
atgaagagttttttaagaaaacccaagttttgacttttattgttgggtggcctttccactagtagtattattctcagtgcctgtgcaacaccttcaaactcagcactgcaagcagtttttaaaccaacttccaaccaattttttaacggtgagcatggtaccattcaaagcgctttaaacaccgctttaagagatccggaaactaacaaaaaatttgtagctgctccacttttaaaagcattagaagcttggtacgagaataatcaagataaaaacattactcaattcttaaaagacaccaagactaatgttgataaccaatacaaaaccgttgtagataaagtagtttcagcaccacgcaataaatccttatttgtacaacaagatttattggacagtagcggtggtagtgaggccacttgaaaagcgcgcaaactgtttgaacagctaattagtgattttgcttcacgagtttttcaaaagaattatttgtcttataaggaaaatggcaaagtatcagccggtccgtttttatacgacacgatttcaaaaaatagtaattgacagaatatagtttttgatgctgttaattttccagaaactaatgatgattttttcgcgaagattcaaagcgaagtttttgatcaatgggctgagtacaccgatccaactattattagctcagttaccttaaagtattcagctcctaattaa

SEQ ID NO: 513 - DNA, 1719 bp, Mycoplasma pneumoniae
atgattaacttcttgtttaaccaaatgaacgcgttgaacaataagtttttggagcgcgctaaagcattaaaccaaaatgtgaatcaggccaatcctacaccttggttaaatggtttatcagctaaattgccttatgttagaacaaatggtaattacgaaaaactcaacaattacttcactttcttaattgttaaatacatgtggaagaaggtcggtaatgaagacgcttcattatctaaagatagtagcattaacaagctcaaaactaagaccgaagacgttaacaaaattagagataaaatcttagaagacattcaaaagaaggttcaagaatttgttaaaaacaagcttaaaccaaccttagcaccacgacaaacttacagtaatgtaattttgttaaacgttaacaacgataaggtttgatcgatgggcgccaattgagctttagctaacttattggatacgagcaaaattaatccactttcatttatgttgctcaaacaaacgtttgaccaaaacgacttgtttaagaaagctaagaaactttttgaagatattcaaagtaaaacaaatggtggaagttcaggtgggatgcaaggtagcaatacctcgagtagtgaaggagctgatgccttgagtaaagtaattggcaactattactacaacagttgagctaaattgactgataaatccatttatggaaatcctaaggacaacaaatttgatgacttatttaaattagcttttgaagatagtattaacgaaaagtcctttaatgttgattacaaagcggtcattgaacactaccgctttatctataccttggaatgactagttaacggtaacttaaagaactttaaggacttattaaaagcaaatttaaagtttggtgaaattgctttcattgcttataaaaacactgaaaccaaagaattttccaatccgcaaggtgtatttggttctgcttttaattacgaaaacgaaactaatgaagttaagattgctgcgcaaaacttagacccaaataatttcttttataaaacaactaccaaaccagaagaagttaaaaccgcacaaaatggtgcaagcatgatggttatgcaacaaaaaatgcaaagtaccatgcaagatagtaatcattatggttttaccgggctaaacaccagtactagttcaatgttaggtgccgctacgcagcaagccattttggatcaaataaccaagaattccttgcaacaatatggttcgcagcaagaactgaaaactttgattgaaaagactaataaccaacttttattagaccgaatcgctagtcaattaagtggattaaatccttcaaccactggaaatagtaataatggaaagggtaaaaatattgctacttatttccaattagatgccattggcaacccaacccttagctttcaacaaaaacgaaaacttttattagatgttttagatcagtacaaagatttctttggtacaaatactcaggctgcacaaagagattctggtaaaggtggacatggaagctattcaacttaccaagatggcagtgacaagatcacttaccttcagttctcctataaagatatagataacttaagtttgagtgataaaggaaatagtaagcttgctagcgatgttgtggctgcccttttacttttccaagcagcggataaaggtacccaacaattagccttgagtgctattaattaa

SEQ ID NO: 514 - DNA, 3735 bp, Mycoplasma pneumoniae
atgaaaaagtttctaagaaaaccccaattttgactcttaacattaggcggttttctgtctactagtgttattttagctgcttgtgctaccccttccaactcggctttacaaaccgtttttaaagcgcgttccagtcagtttttcaatggtgaacagggtagtttacaaagtgccctaacaacggctttaaaaaatccagtggccaacaaacaatttatcgctgcaccacttttaaaagcactagaagcttggtacgaaaacaacgaagacaaaaagattacccagtttttaaaagacactaagtccaatgttgacagtcagtacacaacggcagtcgataaagtggtatcagcatcacgcaataaatcactttttgtgcaacaagatttgttggataacgccggtggtagtgaagcaacctggaaagcgcaaaagctgcttgaacagctcattagtgactttgctagtcgggttttccaaaagaactacctcaattacaaaaaagatggacaagtttctactggtccatttacttatgatgaactacacaaggaagaaagctgaaaaaactttgaatttagtgccccacgttttagtgaaactaatgatgactttttcgccaaaattcaaagccaagtatttgaccaatgggtggagtacactgatcccactttaattagtcaagttaactataagtattctgctcccagtcaagggttaggtcagatctataacagagagaagttaaaggataaactaacaccttcttatgcctttcctttctttgccgaagaaaaagacattgcacccaaccaaaacgttggtaataagcgctgaaagcagttagttaaaggtgagggcgctattactgataataatatcggtcaaagcggtacaaacagccaaaaaactggtctgctcaaataccgtaatgaatcaaataagggtgattttcttgattttcccttaaatttatcagatactaacgaaacgaagcaattagtagacgcttctaacattgtcgatcagttagaagctgctaacttaggtgcagctttaaatttaaaactgcaagtttttgagcaagataatgacgaattgccgcaaattaaggagctcaaagaagaccttaacaacacgattgttgtcgataaaagtaaggacgtagaaaaagcttccaaaactaacgcactgttttacaatgatcaagaaggtaagcaacaacaaagtgactcagatccaattgctggcgctttagatgacatttttgctcaaaacacaagcgaaggcactaacttaagtaagttagcggagcaggtaaagaaagcagctgcaacaaaaatggaagcgaaaacagctgttttaagaactaacaattctaagggccaacaaaacaattacgttgttttagatgcagctattcctacatttaattcaacaacatcaaaatcgaaaaataatagcgcttctaatgaagttttagttgccttaaaatctggatctataaatttaaggcaggttcagcaaactgatcaaaacagttacagtcccattaaattccggattgtgcgtaacagcaccggagtaactgttttcggccttgatggtgggagctattatttaaaacaagattcaacaaataaaaaatcagtttctaagcaaagtttaaccttattaactaaatctagttcaggtaacagtaataaagtattaagagaccttgacaagcaaaaacaattcttaaagtttcgtgcctttcaagctaaaactaacactttctacagtactaactttgcctttagttttcccttaaacgaaacgctaaaaagttggtttgataaacaccgggaactaattttggccaacgccttagttaacgctagtcttgaccaaaaggataaagctagcaaagctttaactgaagcttttaatccttataaagagttaattaaagaatttgcgccggtggctttagcaaccacaatgatcagcttttattttgatcaaatgaaagcgctcaataacaagttgctagagcgcgcccgtaatcttaaccaaaacgtcaaccaagccaatccaaccccttggttgaacggtttgtcagccaagttaccttacgttaatactaacggtaattacgaaaagttaaacaactactttaccttcttaatcacaaaaacattgtgacctaaagttggtcaagaagaaacaagcataagtgaagaaagcaataagctcaaaactaaaactgctgacgttgacaagattagggacaaaatcttggaaaacatccaaactaaagtaaatgattttgttaaaaacaaactcaaacctgctttagcaccccgaccagcttacagtaacgtcattttgttaaacgttaacaatgacaaagtactttctagtggtgctaactggagcttagctagcttattacagagcgacaaagtcaacccgctttcgtttatgttgctcaaacaagcgttcgataataacgatttatttaagaaagcacaaaagttgtttaaagacattcaggaaaagtccagtaataatggtggaatgcaaagtagttccacaaccaacagtgatgccgatgcattaagtaaagttatcggtaactattactacactacttgggctaaactcacggacaaatcgatttacggtaacccgaaggacaacaagtttgatgagcttttcaaactggcttttgaagctagcatcgacgaaaagtcctttaacgttgattacaaagcggtcattgaccattaccgttttatctataccttacagtggctagtggaccaaaaattaaagaactttaagtcactgttaaaaacaaaccttaagtttggtgaagttgcttttatagcttacaagaacactgaaaccactaacttctctaatccccaaggcgtatttggttcctacttcaactatgagaactccgctagcgaagttaaagaatccactcaaacactagatcccaataacttcttttacaaaacaacaaccaagccaacggtacaagccattcaacaagttgctagcttagcattagtacaaaaacaacaaatgcaacaaaattcaactgatcactatggttttactggtttgagtaccagcactagttcgatgttcgatgctagttcccgtgatgccattttgcagcaaattacgaaaacctccttgcaacagtacggttccaaggatcaactcaaaaagatcattcaagggactaataaccaattgttactagaccggattgcagtccagttaagtggattaaatccttccacaactaatggtggcagtggcaaaacaattgcgacctacttccaagtggatgccgttggcaacccaactttggacttccaagctaagcgtaaactgttattagacctcttggaccagtaccaaaactactttggtaatggtgcccaaaagagccaaagggattctactccaagtggaactggcaactacctcacttaccaaaatggtagtgacaagtacacctacacccagttcacttaccaagacattgacagcttgagtctaacaactacaagcggtaccaacaataaaattgccagtgatgttgtggcagcgctgcttttattccaagcagcagacaagggcacacaacagttggcacttagtgccattaataagccgcagttaaatattggtgataaacggatagaaagtgggttaaaattgctcaaatag

SEQ ID NO: 515 - DNA, 969 bp, Mycoplasma pneumoniae
atggttggaagtggtgcggctggaagtgcttctagtttacaaggcaatggctcgaacagttcggggttaaaatcgctcttgagatcagcacctgtcagtgttccaccaagcagtacaagtaatcaaactttaagcttatctaaccccgctcctgtaggcccacaagcggttgtaagccaacccgcggggggtgctacggcagcagtgtccgtcaatcgcacagcgagtgacaccgccacctttagcaagtacctcaacaccgcccaggccttgcaccagatgggggtgattgttccggggttggaaaaatgaggtggtaacaacggtacgggtgtagtggctagccgacgggatgctacttccactaacctgccccatgcggcaggtgcttcccaaacgggtttgggaactggttcgccccgcgaaccagctttaaccgcaacgtcacagcgtgccgtcacggtggttgctggcccccttcgtgcgggcaatagcagtgaaactgatgccctaccgaatgtcatcacccagctctatcatacttcaaccgcccaactcgcttacttaaatggccagatcgttgtgatgagttccgcccgggtaccgagtctttggtattgagttgtcggggaggaccaggaatcgggcaaagcgacctgatgagcgaaaaccgagctcaactggggcaccgacaagcagaagcagtttgtcgaaaaccagttggggtttaaagatgactcaaattcggattccaaaaattcgaatttgaagacccaaggcctcacccaacccgcctacctcatcgccggtcttgacgttgtggccgaccacctcgtctttgcggcatttaaagcgggcgcggtggggtatgatatgacgactgattcgaacgcttcgacctacaaccaagcactcgtctggtcgaccacggccgggttggacagtgatggggggacaaggctttggtag

SEQ ID NO: 516 - DNA, 1158 bp, Mycoplasma pneumoniae
atgccagtttttctaaaattaacgcacacaattagaaaagtgctaagagttgcaagactttctagactagcattactatcactaaccgctgttatttttagcggttgtgccaatattaatttaattagtgctgttggttcttcttcggtacaaccgttgttaagcaaactcagttcgcactatgtcttgaaccacaatgacaaggataaccttgtagaaattagtgtccaagcgggtggctctagtgctggggtgaaagcaatcaccaagggactagctgacattggtaatgtctcgaaaaacaccaagagctatgctgaggaaaacaagcagttgtggatggacaaaaagctcaaaacaattacacttggcaaagatgccattgctgttatttataaagcaccatcagagtttaagggcaaactagttctcactaaagacaacctcaacgatctttacgatctgttcgctggtagcaaaagcgttgacattaataagtttgtcgaaaacggacaaaccactaaaaacagtaatcataatttgataggcttcccccgtactgggggcgcttttgcttctggtaccgctgaagctttcttgaagttttcgggtcttacacagacaaaaactttagataaagattccaaagaaattttggaaggtcaacgcaactatggccccaatgcgcgaccaactagtgaaaccaacattgaggcctttaatacctttgtcacaactttgcgacaacccaatttatacggcatggtgtacctcagtttagggtttgtgaataacaacatgaacctaattaagagtgaaggttttgaggttttaaaagtcaaatatgataataacgcagttaccccctccagtcaagcagtttctagcaacacttacaaatgggtacgcccgttgaactcagtggtttccctgttaccaaaacaaaaaacactgccaagtatccaacgcttttttaactgattgttatttagcaacaacagtgaaattaagaaaatatacgatgactttggtgtgttagagttaacggctgacgaaaagaaaaagatgtttaaaacaggtaatgcagaaatgagcaacattgccaacttctgggttgatgattacagtctgaacaaccaaaccttcggtgcactctag

SEQ ID NO: 517 - DNA, 9903 bp, Mycobacterium tuberculosis H37Rv
atgagcttcgcggtgctgcccccggagatcaattcggcgcgcctgtacgtgggtgccgggttggcgccgatgctggacgcggcggccgcttgggatggactggccgacgaattgggttcggccgcggcctcgttttcggcggtgacggcggggctggcaggttcctcgtggctgggcgcggcgtcgacggcgatgacgggagcggccgccccctatctgggctggttgagcgcggcggcggcgcaggcccagcaggcggccacccaaacccggctggcggcggccgccttcgaggcagccctggcggcgacggtacatccggcgatcatctcggccaaccgggcactgttcgtgtcgctggtggtctcgaacctgctgggccaaaacgccccggcgatcgcggccaccgaggccgcctacgagcagatgtgggcccaggacgtggcggcgatgtttggctaccatgccggggcttcggcggccgtctcggcgttgacaccgttcggccaggcgctgccgaccgtggcgggcggcggtgcgctggtcagcgcggccgcggctcaggtgaccacgcgggtcttccgcaacctgggcttggcgaacgtcggcgagggcaacgtcggcaacggtaatgtcgggaacttcaatctcggctcggccaacatcggcaacggcaacatcggcagcggcaacatcggcagctccaacatcgggtttggcaacgtgggtcctgggttgaccgcagcgctgaacaacatcggtttcggcaacaccggcagcaacaacatcgggtttggcaacaccggcagcaacaacatcggcttcggcaataccggagacggcaaccgaggtatcgggctcacgggtagcggtttgttggggttcggcggcctgaactcgggcaccggcaacatcggtctgttcaactcgggcaccggaaacgtcggcatcggcaactcgggtaccgggaactggggcattggcaactcgggcaacagctacaacaccggttttggcaactccggcgacgccaacacgggcttcttcaactccggaatagccaacaccggcgtcggcaacgccggcaactacaacaccggtagctacaacccgggcaacagcaataccggcggcttcaacatgggccagtacaacacgggctacctgaacagcggcaactacaacaccggcttggcaaactccggcaatgtcaacaccggcgccttcattactggcaacttcaacaacggcttcttgtggcgcggcgaccaccaaggcctgattttcgggagccccggcttcttcaactcgaccagtgcgccgtcgtcgggattcttcaacagcggtgccggtagcgcgtccggcttcctgaactccggtgccaacaattctggcttcttcaactcttcgtcgggggccatcggtaactccggcctggcaaacgcgggcgtgctggtatcgggcgtgatcaactcgggcaacaccgtatcgggtttgttcaacatgagcctggtggccatcacaacgccggccttgatctcgggcttcttcaacaccggaagcaacatgtcgggatttttcggtggcccaccggtcttcaatctcggcctggcaaaccggggcgtcgtgaacattctcggcaacgccaacatcggcaattacaacattctcggcagcggaaacgtcggtgacttcaacatccttggcagcggcaacctcggcagccaaaacatcttgggcagcggcaacgtcggcagcttcaatatcggcagtggaaacatcggagtattcaatgtcggttccggaagcctgggaaactacaacatcggatccggaaacctcgggatctacaacatcggttttggaaacgtcggcgactacaacgtcggcttcgggaacgcgggcgacttcaaccaaggctttgccaacaccggcaacaacaacatcgggttcgccaacaccggcaacaacaacatcggcatcgggctgtccggcgacaaccagcagggcttcaatattgctagcggctggaactcgggcaccggcaacagcggcctgttcaattcgggcaccaataacgttggcatcttcaacgcgggcaccggaaacgtcggcatcgcaaactcgggcaccgggaactggggtatcgggaacccgggtaccgacaataccggcatcctcaatgctggcagctacaacacgggcatcctcaacgccggcgacttcaacacgggcttctacaacacgggcagctacaacaccggcggcttcaacgtcggtaacaccaacaccggcaacttcaacgtgggtgacaccaataccggcagctataacccgggtgacaccaacaccggcttcttcaatcccggcaacgtcaataccggcgctttcgacacgggcgacttcaacaatggcttcttggtggcgggcgataaccagggccagattgccatcgatctctcggtcaccactccattcatccccataaacgagcagatggtcattgacgtacacaacgtaatgaccttcggcggcaacatgatcacggtcaccgaggcctcgaccgttttcccccaaaccttctatctgagcggtttgttcttcttcggcccggtcaatctcagcgcatccacgctgaccgttccgacgatcaccctcaccatcggcggaccgacggtgaccgtccccatcagcattgtcggtgctctggagagccgcacgattaccttcctcaagatcgatccggcgccgggcatcggaaattcgaccaccaacccctcgtccggcttcttcaactcgggcaccggtggcacatctggcttccaaaacgtcggcggcggcagttcaggcgtctggaacagtggtttgagcagcgcgatagggaattcgggtttccagaacctcggctcgctgcagtcaggctgggcgaacctgggcaactccgtatcgggctttttcaacaccagtacggtgaacctctccacgccggccaatgtctcgggcctgaacaacatcggcaccaacctgtccggcgtgttccgcggtccgaccgggacgatcttcaacgcgggccttgccaacctgggccagttgaacatcggcagcgcaaatctcggcgacttcaacctgggcagcggaaacgtcggcagcttcaacgtcttctccggaaaccagggctcatacaatatcggtccggcgaacctgggtaactacaacatcggtttcgcgaacctgggtaactacaacatcggcttcggcaacgccggcgatttcaaccaaggctttgccaacaccggcaacaacaacatcggatttgccaacaccggcaacaacaacatcggcatcgggctgtccggcgacaaccagcagggcttcaattttgctggcggctggaactcaggcaccgcgaacatcggcttgttcaactccggcaccaacaacgtcggcatcggcaactcgggcaccggcaactggggtatcggcaactccggcagcggcaacaccggcatcggcaacaccggcagcactaacacgggcttcttcaacaccggcatcgtcaacaccggtgtcgccaacgcgggcagctacaacaccggctggtacaacaccggcgacaccaacaccggcatcgccaacctgggcgacttcaacacgggcttctacaacaccggcaatttcagtacgggctttgccaaccagggtgatatcgccaccggggctttcatcaccggcgacatgggcaacggcgccttctggcgcggcgaccagcagggcctattcagcgcgggctatcgggtccatgttcccgaaatacccgcacacgtcaccgtggaagttcccgtcaacatccccatcaccgccagcttcaccaacaccgtctacagcggcataacgcttgagcaaatcaacttcggtttcaccatcgacatcgcagggatccccctgctggccggtgcaatcagcaaggccgttctcccgcccatcaccgggaccggtcccgcgatcacggtcaacatcggcgaccctggcggttcgaccgcgatcaggatcccggccaccgcaagcgtcggtcccttcgatgtcacgttcgtcaacattgcggctaccacgggctttttcaacgccaccaccgatccgtcctcgggcttcttcaacggcggccccggaaccgtatcgggcatcgccaacatcggcgccaacatttccggcttccagaacgtcgcgaactccgcgacctcgggcttcaacaactacggctcgctgcaatcgggactggcgaacctgggcgataccgtctcgggcgtattcaacaccggcatcggggcaccggccaacgtctcgggcatgttcaacatcggcagcaacctcgcggggttcttccacgaccaggcgaccgggatgtcgatgttcaacctcggcctgggaaacatcggccaattcaacgtcggcttctccaacgtaggcgacagcaacgccggcttggcgaacatcggcagcttcaacctcggcagcggcaacctcggcagcttcaacgtcttcggcggaaaccagggctcatacaacatcggcccggcgaacctgggtaactacaacatcggcctaggcaacctgggcagctacaacttcggattcggcaacgccggcgacttcaacctgggcttcgccaacaccggcaacaacaacatcgggtttgccaacaccggcaacaacaacatcggtatcggcctgtccggcgacaaccagcagggcttcaattttgccggtggctggaactccggcagcggcaacagcggcctgttcaactctggcaccaacaacatcggtttgttcaactcgggcaccggcaacatcggcatcggcaactcgggcaccggaaactggggcatcgccaacaccggtgacaccaacaccggcatcttcaacaccggcgacgtcaacaccggcttgctcaacgccggcaacgtcaacaccggcatcttcaacaccggccattacaacaccggcagcttcaacgccggcagcttcaacacggccggcttcaacccgggtagctacaacacgggttatttgaacaccggcagctacaacaccggactggccaactcgggcgatgtcaacaccggcggcttcatcaccggcaattacagcaacgggttctggtggcggggcgattaccaaggcctggcggggatcagccaaacgatcaccgtgcccgacaccgccgttccggtgaaactgcacgtgccgatcttcctcgatatcccggtcaccggcacacttggcacgttcaccgttcatggcttcagattcccggagatcaccggcgatatcttcttgatcggcataccgttcaatgccgccacactcgatgcattcagtttcccgaacatctcgattgtccttcccaatatcggcatcaacctgggtagcgggccggacccgctgatcgatatcgccggcaccggcggtctattgccgatcaagattccactcatcgatataccggcggccccgggattcgggaactcgacgaccaccccgtcgtcgggattcttcaacgccggtaccggtaccgtgtcgggcgttggcaacgtgggcagcaatagttccggcttcttcaacctcacctctggaagctcgggaatctcgggcgtccagaacttcggcgagctgatctccggcgggttcaacttcggtaacactgtctccggccttgtcaatgcgagcacgcttgggctttcgatgccggccaatctctccggcggagggaatgtcggtgctacggtcgccggcttcgtcaacaacacccagatcctcaacctcgggtttggcaacgtaggcagcgggaatgtcggccacggcaatatcggcgactccaacgtcggcctcggaaacctcggcaacgcgaacgtcggccatggcaacatcggcagcttcaacgtcttctccggaaaccggggctcatacaatatcggcccggcgaacctgggtaactacaacatcggcctaggcaacctgggcagctacaacttcggattcggcaacgccggcgatttcaacctgggcttcgccaacagcggcagcaacaacatcgggtttgccaacaccggcaacaacaacatcggtatcgggctgtccggccacaatcaacaggggttcggctcctggaactccggtaccgccaacaccggcctgttcaactcgggcaccaacaacatcggtttgttcaactcgggcaccggaaacatcggcattggcaactcgggcatcggaaacaccgggatcggcaacccgggtgtcggcaacaccggcttggggaactcgggcaccggcaactggggcctgtggaacccaggcaccggcaatatgggcgtcgccaacgtgggcacctacaacaccggtggctacaacgtgggcagcaccaacaccggcatcgccaacgtgggcatcgccaacacgggcagctacaacaccggcagcaccaacaccggcagcttcaacgacggcgacttcaataccggcttctacaacaccggcgactacaacaccggcttctacaacaccggcgacgtgaacaccggcgccttcatcgggggcaacttcagcaacggcgccttctggcagagcgatcaccaaggccagtggggcgcacactacgcaatcactgttccccagatcccgctactgaactttagcctcaacattccggtcaacatccccatccatctcgacttcggtacccttgccgtcaacggcttccagattccggctatcaccctccgcgccctcggggtcacccacttcagcgtcggacccatcatcgttccgaggatcgccggcaccttaccggtgatcgatatcaacatcggcgaccccggcggttcatcctcgatacccatcacgatcaccagcggcgccggcccggtcgtcatcccgctactggacatcccgccggcccccggtttcggaaactcgaccaccggcccctcatcgggcttcttcaactccggcaccggcagctcgtctggattcggaaacgtcggcgccaacaattcgggcttctggaacaccgctttcgccggcataggaaactctggcttgcagaacttcggctcgctgcaatccggctgggcgaacttgggcaacaccgtctcgggcttctacaacaccagtgcggcggacttcgcgacgccggctaacctctcgggactctccaacgtcggcgccgacctgaccggcgtgctccgcggcccgaacgggtcgaccttcaacgcgggcctggcaaacctcggccaattcaacgtgggcagtgcaaacctcggcagtgcaaacctcggcagtgcaaacctcggcagtgcaaacctcggcaattcaaacgtcggcttcggcaacattggcaacgcgaacatcggcggcgcaaacatcggcgactttaacgtcgggatcgcaaacaccggtccggggctaacggcggctgtcaacaacatcggtatcggcaacaccggcaactacaacatcggtgtcggcaacaccggtaactacaacatcggcttcggcaacaccggcaacaacaacatcggcatcggcctgtccggcgacaaccagatcgggttcggcccgctgaacgccggcatcgccaacatgggcctgttcaacctgggcgacaacaactttggcatggccaacgcgggcaacttcaaccagggcattgccaacaccggcaacaacaacatcggcttgttcaacaccggcaacaacaacgtcggcatctggctgaccggcgacggcttgtccggcttcagctccctgaactccggcgccggcaacaccggtttcttcaactccggcaccgccaacaccggcttgttcaactccggcaccggcaacaccggcttgttcaactcgggcaccggcaacgtcggcatcggcaacatgggcaccggcggcttcggcgtcggcctatccggcgacagccaggtgggcatcggcggcaccaactcgggcagtttcaacatcggcttgtttaactcgggcaccggcaatgtcggcatcggcaactcgggcaccggcaacgtcggcatcggcaacaccggcaccggcaacaccggcatcggaaacagcggcaactacaacaccggcttgctcaacgcgggcctggtcaacaccggcatcgccaacccgggcaaccacaacaccggcctgttcaacatcggcaccttcaacaccggcatcgccaacccgggccactacaacaccggctcctacaacaccggtagctacaacaccggcatggcaaacgccggagactacggcaccggcgcgttcatcaccggcagcatgaacaacggcttgctctggcgcgccgaccggcagggcctgctggcggccaactacaccatcaccatcgagcgacctgccgcgttcctcaatgtcgacatcccggtcaacatccccatcaccggcgacatcaccaatgtctccatccccgccattacgttccccagaatcgacgccagcggaagcgtcgacataggcatcctcagtggcaccgtcttggccccggtcggtccgatcaccctgcatggcggggacgcgtcggccccgctggacacacccatcgaaattgacttcggcccctcgccggcgatcaacctcaacatcggcaagcccgacggctccaccgtgatcaacatcgtgggcggcgccggcgccggcccgatcagcattccgatcatcgacttgcggccagcgcccggcttcttcaacgccaccaccggcccgtcgtcgggcttcctcaactggggtgctggcagcgcatcgggcttgctgaacttcggcaacaactcgggcctctacaacttcgccactagcagcatgggaaattcgggcttccaaaactatgggtcgctgcagtcgggctgggcgaatttgggcaacagcatctcgggcatctacaacaccggcttgggagcaccggcaaatgtctcgggcttgctcaacatcggcaccaacctggctgggtggttgcagaacggcccgaccgagacgaccttcagcgtgggcttggccaacctcgggttctggaatctgggtagcgcaaacatcggcaactacaacctgggcagcgccaacatcggcgtctacaacctgggcagcgccaacatcggcgacttcaacctgggcagcgccaacatcggcgacttcaacctgggcagcgccaacatcggcagctccaacatcgggttcggcaacgtcggtccggggctgacggcggccatcggcaacatcggcttcggcaacaccggaaacggaaacatcggcatcggcaataccggcaccggcaacatcggcttcggcaacaccggaaacggaaacatcggcatcgggctgaccggcgacaccatgaccgggttcggcggctggaactcgggcaccggcaacatcgggctattcaactccggcaccggcaacatcggcttcggcaactccggcaccggcaactggggcatcggaaactccggtgactacaacaccggcatcggcaacaccggcagcaccaactccggcttcttcaacaccggcctggtcaacaccggcattggcaactccggtgactacaacaccggcctattcaacgccgggaacaccaacaccggcagcttcaaccccggcgactacaacaccggcggcttcaaccccggtaactacaacaccggctacttcaacccgggcaactccaacaccggcatcgccaactccggcgatgtcaacaccggcgccttcaattcgggcaactacagcaacggcttcttctggcggggcgactaccagggcctaggcggtttcgcctaccagagcgccgtttccgaaatcccgtggagctacgacaggttccaacattga

SEQ ID NO: 518 - DNA, 6615 bp, Mycobacterium tuberculosis H37Rv
atgaacctggtctccacaacgtcgggaatgtcgggcttcctcaacgtcggcgcgctgggatcgggtgtggcgaatgtgggcaacaccatctcgggtatctacaacgtgggcacgtcggacctctcgacgcccgccgttaactccgggttggcaaatatcggaaccaatattgccggcctgctgcgcgacggcgcgggtactgcggctattaacttgggcttggccaaccacggcaacctcaacgtgggcttcgcaagtctcggcggctttaacttcggcggcgccaccatcggccacaacaacgtcggcatcgggaacaccggaatcttcgatgtcggcctggcgaacctgggcagctacaacatcggcttcggaaaccttggcgacgacaacctgggcttcggcaacttcggcagctacaacatcggcttcggcaacgtcggcaacgacaatctgggtttcgctaacgcgggcggcggcaacatcggctttgcgaacaccggcagcaacaatgtcggctttgggaacacgggcagcaacaatgtcggcatcgggctcacgggcaacggacagatcgggttcggcagcttcaactcgggcagcggaaacatcggcctgttcaactcgggcagcaacaacatcggattcttcaattccggcagcggcaacttcggcatcgcaaactcgggcagcttcaacactggcatcggaaacaccggcaacaccaataccggcctattcaactccggcgacgtcaacacgggcgccttcaacccgggcagcttcaacaccggtagcttcaacaccggcagcttcaacaccggtggcttcaatccgggcaataccaacaccggctacctcaacattggcaactacaacaccggcatcgccaacaccggcgacgttgacaccggggctttcatcaccggaaactacagcaacgggttgttcttaagcggcgattaccagggcctggtcggcctcaacctggtgatcgatatgcctctccccataagcctcggcgtgaatattcccatcgatatcccgatcaccgcctcggccggcaacatcacccttatgggcgtcacgattccgcccaccggcgatatcgtcctttcgtcaatagcgggccagcgagcccactttggccccattaccattccgaacatcacggttgtcggccccacgacgacagtcgccataggagggccgaataccgcgatcaccataactggcggtggcgccattaggatcccgctcatcagtatcccggcggcgccaggtttcggaaactcgaccaccaacccgtcgtcaggtttcttcaataccggcgccggcggcgcctcgggcttcggcaacttcggcggcgccaattcgggcttttggaacctggcctccgcgacctcgggggcgtcggggctcctcaacgtcggcgccctgggatcaggtctggcgaacgtgggcaccaccgtctcggggttctacaacaccagcacgtcggacctcgcgacgccggccttcaattcaggcctggccaacatcagcaccagtatcgccggcctgctgcgcgacagcacgggcaccatggtcctcaacctgggcttggcaaaccacggcaccctcaacgtcggcattgcaaacctcggcgactacaacatcggctttgcaaacctcggcagcgccaacttcggcagcgccaatatcggtggcaacaacatcggcggcgcaaacaccggaatattcgacatcggtttggcaaatctgggcagttacaacatcggcttcggaaacttcggcgatgacaacctgggcttcggaaacctcggcagctacaacgtcggcttcggaaacttgggcaacgacaacctgggcttcgccaacaccggcagcaacaatatcgggttcgcgaacaccggcagcaacaatatcggcattgggctcacgggcgacggccagatcgggttcggctccctgaattctggcagcggaaacatcggcttgttcaactcgggcagcggaaacatcggctttttcaactcgggcaacggaaacgttggcatcggcaacaccggcaccgcaaacttcgggcttggaaacaccggcagcaccaacaccggcttcttcaactccggcgacgtcaataccggtatcggcaacaccggcagcttcaacaccggcagcttcaatccgggcgattccaacaccggggatttcaacccaggcagctacaacacgggactcggaaacaccggcgatgttgacaccggcgccttcatctccggcagctacagcaacgggttcttgtggagtggaaattatcagggcctcattggcttgcacgcggcgctagcgattcccgaaatcgccctaacctttggcgtcgacatcccgatacatatacccatcaacatcgacgccggggtcgtcaccctccagggcttcagcatcgtagctgccgaaaataatatcgacttcacccccatcatcatcccgaccatcaatatcaccttgcccacggcggcgatcaccgtgggcggacccaccacctcgatcggtatcaccgccagcgccggtatcggctccatcaccatcccgatcatcgacattcccgcgacatcgggcttcggcaactcgaccactagtccgtcgtcgggcttcttcaactccggagcgggcagcgcgtcgggctttttgaacgtggtcgccggcgcctcagggatttcgggttatctcaatgtcggtgcgctggggtcgggtgtgactaacgtgggtcacaccgtctcgggtttctacaacgcgagcgcgttggacctcgtgacgccggcctttgcctccggtctcatgcgcgacggtatgggcacgatgactctgaaccttgggctggcaaacctgggcagcaataacgccggcttcggcaacaccgggatctttgacgtcggcgtggcgaatctgggcaactacaacatcggcttcggaaacttcggcgacgacaacctgggctttgccaacctaggcagctacaacatcggcgttgccaacaccggcagcaacaatatcggctttgccaacaccggcagcaacaatatcggcatcgggctcaccggtaccggccaaatcgggatcggcgctctgaactcgggcagcggaaacatcggcttgttcaactcgggcgacggaaacatcggcttctttaactcgggcaccgggaacttcggcatcggcaacaccggcaccggaaacttcggcatcggcaactcgggcagcaccagcacgggcttgttcaactcgggcgacggcaacaccggcggcttcaaccccggtaacttcaacaccggcaatttcaataccggcagcttcaacaccggcggcttcaacgcgggtaacaccaacaccggccacttcaacaccgggaactacaacaccggcatcgcgaatacgggcgacgtcagcaccggcgctttcatctccggcaactacagcaacggcatcttgtggcggggcgactaccagggcctgatcggttactcctacgcgctgactattccggagattccggcgcacttggacgtcaatatcccaatcgacataccgatcaccggcagtttcaccgacctcgtggtggacaatttcactatccccatcatcggcttcgaatccttcgcgtttagctttcacatccataccgagccggacatcggtcccatcattgtcccgagcttcgtgctcagcgttcccacgttcgcgatcgccgtgggcggacccacgaccgcgatcaacatcagcgccaccgccggcctcggccccatcaccatcccgatcatcgacattccggcagcgccgggcatcggaaactcgaccaccagcccgtcgtcaggcttcttcaacaccggcgccggcaccgcatccgggttcggcaacgtcggcggcaacacatcgggcctgtggaaccttgcgtcggcagcctcaggagtctcgggcttgctcaacgtcggcgcgttgggatcgggtgtggcgaatgtgggcaacaccatctcgggtatctacaacacgagcccgctggacctcgggacgccggccttcggctccggcctcgcaaacatcgccggcctgctgcagggcggcgccggcacgacgatcctcgacttggccggcctcggcaacctcaatgtcggcttggcaaacctcgggggctctaacttcgggatcgggaacaccggaatcttcaatgtcggtttcgcaaacgtgggcaaccacaacattggcttggcaaacctgggcaactacagcgtcggcttcgccaactcgggcaactaccatatcggcattgctaacaccggcagtgccaatatcggcttcgccaacaccggtagcggcaatatcggcatcgggctcaccggcaccggtcagatcgggttcggcagcttcaactcgggcagccacaacatcggcttgttcaactccggtgacggaaacgtaggattcttcaactcgggcaccggcaacgtgggcatcggaaacaccggcaccgcaaacttcggcatcgcaaactcgggcagcttcaacaccggcctcgggaacacgggcagcaccaacacgggcctgttcaacccgggcaacgtcaacaccggcgtcggcaacaccggcagcatcaacaccggcagcatcaacaccggcagcttcaacactggcagcaccaataccggcagcttcaacctcggcgatcacaacaccggcagcttcaactccggtgactacaacacgggctacttcaacgcgggtgactacaacacgggtgtggccaacacgggcaacgtcaacaccggcgcgttcatctccggcaattacagcaacgggttcttctggcgaggtgactaccaggggttgattggcctttccacaacgatcaccattcccgaaatcccctaccgctacgacttgagtgttccaatcgacatacccatcaccggcaccgtcgtcgccaccacgccaaacagtttcaccattcccggtttccagatacgagtcttgcttggtcctgcggcggtgcttgtcaacgagatgatcggccccatcacgatcgatgtcaatcaagtcatcgccatcgattcgcccattcagcaaaccatcagcatggttggcaccggcggcttcggcccgatccccatcggcatcagcatcggtggtaccccgggtttcggcaactcgaccaccggcccgtcgtcgggtttcttccacaccggcgccggccatgtatcgggcttcgggaacttcggcgccggcaacatgtcgggctccgggaacttcggcgctggcaattcgggcttctttaacgccggcggcttgggcaattcgggcctactgaatttcggcgcgctgcagtcgggtctggcgaacctgggcaacaccatctcgggcgtctacaacacgagcacgctggacctcgcgacgcccgccttcggctcgggcatcgcaaacatcggcgccaacctggccggcctgttcctcgacaacaccggcaacctgacgctgaacttcggcgtcgcaaaccagggcggcctcaacgcgggcatcgggaacctgggcagcgtcaacatcggcttcgttaataccggcgactccaacctgggcatcggcaacctcggcgacctcaacttcggcggggtcaacatcggcggtaacaacatcggcatcgccaacaccgggatcttcgatatcggcttggcgaacctgggcagctacaacatcgggttggcaaatctgggcgacgacaacctgggctttggcaacgccggcagctacaacatcggcttcgcgaacttcggcagcgacaacctgggctttgccaacaccggcagctacaacatcggcttcgcgaataccggtaacaacaacatcggcgtcgggctcaccggcaacggccagatcgggatcggcagcctcaactcgggcagcaacaacatcgggctgttcaactccggcagcggaaacatcgggttcttcaactcgggcaccggcaacgtcggcatctttaacaccggcaccggcaacttcggtctcgcgaactcgggcggcttcaacaccggcatcggcaacgcgggcagcaccaacacgggcgtgttcaaccccggggacctcaacaccggcagcttcaacccgggcagcttcaacaccggcggcttcaacccgggcagtggcaacacgggctacctcaacaccggtgactacaacacgggcgtggcgaacacgggcgatgtggacaccggtgcgttcattaccggcagctacagcaacggcttcttggtgagtggcgactatcagggcctgatcggcctgccgctgttgggcattccggtgacccccggctacttcaacctcactggcggcccgtcgtcgggcttcttcaacagcggcgccggaagcgtatcgggattcgtgaactccggtgccggcctgtcgggctacctcaataccggcgcgctgggatcgggtgtcgccaacgtgggcaacaccatctcgggctggttgaacgccagcgcgctggatctcgcgacgccggggttcctttccggcatcggtaactttggcaccaacctggcgggtttctttaggggataa

SEQ ID NO: 519 - DNA, 5706 bp, Mycobacterium tuberculosis H37Rv
atgtcgttcgtgttgatcgcaccggaattcgtgacagcagccgcgggggatctgacgaatctgggttcgtcgattagcgcggccaacgcgtcggcagccagtgcgaccacgcaggtgctggctgcgggcgccgatgaggtgtctgcccgtattgcggcgctgttcggcgggtttggcctggagtaccaggcgattagtgcgcaggtggcggcctaccaccagcggtttgtgcaggccttgagtaccggcgcgggcgcatatgcctcggccgaggccgccgccgctgagcagatcgtgctgggcgtgatcaatgcgcccacccaggcgctgctggggcgcccgttgatcggtgacggcgccaatgcgacgactcccggcggggccggcggggccggcggtctgctgttcggcaacggcggggccggggcagccggggcgcccggccaggccggcgggcctggcgggcccgccggattgtggggcaacggcgggcccggcggggccggcggcagcggtgggggcaccggcggtgccggcggcgccggtgggtggctgttcggggttggcggcgccggcggtgtcggtggggccggtggcggcaccggcggggcgggcgggcccggtggtttgatctggggcggcggcggggccggcggtgtcggtggggccggtggcggcaccggcggggccggcggccgcgccgagctgctgttcggcgccggcggtgcgggtggggcgggcaccgacggcgggcccggtgctaccggcgggaccggcggacacggcggagtcggcggcgacggcggatggctggcacccggcggggccggcggggccggcgggcaaggcggggcaggtggtgccggcagcgatggtggcgcgttgggtggtaccggcgggacgggcggtaccggcggcgccggtggcgccggcggtcgcggcgcactgctgctgggcgctggcggacagggcggcctcggcggcgccggcggacaaggcggcaccggcggggccggcggagatggcgttctggggggtgtcggtggcactggtggtaagggcggtgtcggcggcgtggctggcctcggcggggccggtggtgccgcgggccagctcttcagcgccggaggcgcggcgggtgccgttggggttggcggcaccggcggccagggtggggctggcggtgccggagcggccggcgccgacgcccccgccagcacaggtctaaccggtggtaccgggttcgctggcggggccggcggcgtcggcggccagggcggcaacgccattgccggcggcatcaacggctccggtggtgccggcggcaccggcggccaaggcggcgccggcggcatgggtggctccggtgctgataatgccagcgggattggcgccgacggcggcgcgggtgggactggcggtaacgccggcgccggcggggccggcggggccgccggcaccggaggaaccggcggggttgtcggcgccgcgggcaaggccggtatcggcggcaccggcggccaaggcggcgccggcggcgcgggcagcgccggcacggatgcgaccgctaccggtgccaccggcggcaccgggttttccggtggagccggcggggccggcggggccggcggcaacaccggggttggcggcaccaacggctccggcgggcaaggcggcaccggcggcgcgggcggcgccggtggtgctggcggtgtcggcgccgacaaccccaccggcatcggcggcaccggcggcaccggcgggaaaggcggcgccggcggggccggcgggcagggcggtagcagcggtgccggcggcaccaacggctctggtggcgctggcggcaccggcggacaaggcggcgccgggggcgctggcggggccggcgccgataaccccaccggcatcggcggcgccggcggcaccggcggcaccggcggagcggccggagccggcggggccggtggcgccatcggtaccggcggcaccggcggcgcggtgggcagcgtcggtaacgccgggatcggcggtaccggcggtacgggtggtgtcggtggtgctggtggtgcaggtgcggctgcggccgctggcagcagcgctaccggtggcgccgggttcgccggcggcgccggcggagaaggcggagcgggcggcaacagcggtgtgggcggcaccaacggctccggcggcgccggcggtgcaggcggcaagggcggcaccggaggtgccggcgggtccggcgcggacaaccccaccggtgctggtttcgccggtggcgccggcggcacaggtggcgcggccggcgccggcggggccggcggggcgaccggtaccggcggcaccggcggcgttgtcggcgccaccggtagtgcaggcatcggcggggccggcggccgcggcggtgacggcggcgatggggccagcggtctcggcctgggcctctccggctttgacggcggccaaggcggccaaggcggggccggcggcagcgccggcgccggcggcatcaacggggccggcggggccggcggcaacggcggcgacggcggggacggcgcaaccggtgccgcaggtctcggcgacaacggcggggtcggcggtgacggtggggccggtggcgccgccggcaacggcggcaacgcgggcgtcggcctgacagccaaggccggcgacggcggcgccgcgggcaatggcggcaacgggggcgccggcggtgctggcggggccggcgacaacaatttcaacggcggccagggtggtgccggcggccaaggcggccaaggcggcctgggcggggcaagcaccacctcgatcaacgccaacggcggcgccggcggcaacggcggcaccggcggcaaaggcggcgccggtggtgcgggaaccctgggcgtcggcggctccggcggcaccggcggggacggcggcgatgcgggctctggtggtggcggcggcttcggcggggccgcgggtaaggccggcggcggcggaaacggcggccgcggcggtgacggcggcgatggggccagcggtctcggcctgggcctctccggctttgacggcggccaaggcggccaaggcggggccggcggcagcgccggcgccggcggcatcaacggggccggcggggccggcggcaacggcggcgacggcggggacggcgcaaccggtgccgcaggtctcggcgacaacggcggggtcggcggtgacggtggggccggtggcgccgccggcaacggcggcaacgcgggcgtcggcctgacagccaaggccggcgacggcggcgccgcgggcaatggcggcaacgggggcgccggcggtgctggcggggccggcgacaacaatttcaacggcggccagggtggtgccggcggccaaggcggccaaggcggcctgggcggggcaagcaccacctcgatcaacgccaacggcggcgccggcggcaacggcggcaccggcggcaaaggcggcgccggtggtgcgggaaccctgggcgtcggcggctccggcggcaccggcggggacggcggcgatgcgggctctggtggtggcggcggcttcggcggggccgcgggtaaggccggcggcggcggaaacggcggtgttggcggtgacggcggcgagggagccagcggtctcggcctgggcctctccggctttgacggcggccaaggcggccaaggcggggccggcggcagcgccggcgccggcggcatcaacggggccggcggggccggcggcaccggcggggccggtggtgacggcgccccggcgaccctgatcggcggacccgacggcggtgacggcggccaaggcggcatcggcggggacggcggcaacgccggattcggcgccggtgttcccggcgacggcggggacggcggcaacgccggattcggcgccggtgttcccggcgacggcgggatcggcggcaccggcggggccgggggcgccggcggcgccggcgccgacggggaccccagcattgacggcggccaaggtggtgccggcggccacggcggccaaggcggcaaaggcggcctgaacagcaccgggctagccagcgccgccagcggtgacggcggcaacggcggggccggcggggccggcggcaacggcggcgacggcgacggctttatcggcgggtccggcggcaccggcgggaccggcggcgacgccggcgtcggcggcctggccaacaccggcggaaccgcgggcaacgccggtatcggcggggccggcggccgcggcggcgacggcggggccggcgacagcggcgccctctcccaagacggcaacggcttcgccggcggccaaggcggccaaggcggggtcggcggcaacgccggcgccggcggcatcaacggggccggcggcaccggcggcaccggcggggccggtggtgacggccagaacggaacgacaggcgtggcgagcgagggcggcgccggcggccaaggcggtgacggcggccaaggcggcatcggcggggccggcggcaacgccggattcggcgccggtgttcccggcgacggcgggatcggcggcaccggcggggccgggggcgccggcggcgccggcgccgacggggaccccagcattgacggcggccaaggtggtgccggcggccacggcggccaaggcggcaaaggcggcctgaacagcaccgggctagccagcgccgccagcggtgacggcggcaacggcggggccggcggggccggcggcaacggcggcgacggcgacggctttatcggcgggtccggcggcaccggcgggaccggcggcgacgccggcgtcggcggcctggccaacaccggcggaaccgcgggcaacgccggtatcggcggggccggcggccgcggcggcgacggcggggccggcgacagcggcgccctctcccaagacggcaacggcttcgccggcggccaaggcggccaaggcggggtcggcggcaacgccggcgccggcggcatcaacggggccggcggcaccggcggcaccggcggggccggtggtgacggccagaacggaacgacaggcgtggcgagcgagggcggcgccggcggccaaggcggtgacggcggccaaggcggcatcggcggggccggcggcaacgccggattcggcgccggtgttcccggcgacggcgggatcggcggcaccggcggggccgggggcgccggcggcgccggcgccgacggggaccccagcattgacggcggccaaggtggtgccggcggccacggcggccaaggcggcaaaggcggcctgaacagcaccgggctagccagcgccgccagcggtgacggcggcaacggcggggccggcggggccggcggcaacggcggagccggcgggctcggcgggggcggtggcacaggcggcaccaacggcaacggcggcctcggcggaggcggcggcaacggcggagccggcggtgccgggggaacgcccaccggcagtggcaccgaggggaccggcggcgacggtggagatgccggcgccggcggcaacggcggctctgccaccggcgtcggtaacggcggtaacggcggtgatggcggcaacggcggcgacggcggcaacggcgcacccggcggcttcggtggcggcgctggcgccggcggcttgggcggctccggcgccggcggcggcaccgacggcgacgacggcaacggcggcagccccggcaccgacggcagctaa

SEQ ID NO: 520 - DNA, 3990 bp, Mycobacterium tuberculosis H37Rv
atgtcgttggtgatcgtggccccggagacggtggcggccgcagccttagatgtggcgcgcatcgggtcatcgatcggcgcggccaatgcggcggcggcggggtcgaccaccagcgtgctggccgcgggcgccgatgaggtgtcggcggcgatcgcgacgctgtttggcagccatgctcgggagtatcaggcgatcagcacgcaggtggcggcgtttcatgaccgatttgcgcagacgttaagcgccgcggtcggctcgtatgtcagcgcggaggcgaccaacgccgcaccgttggcgacgctggagcacaacgtgctcaatgccctcaatgcgcccacccaggcgttgctgggtcgcccgttgatcggtgatggggcggctggagcacccggcaccgggcaggccggcggggccggcgggatcttgtggggcaacggtggggccggcggctcgggcgcgcccggccaagtcggcggggccggcggggccgccgggttgttcggcaccggcggggccggtggggccggtggggccggcgccgccggtggggccgggggtagcggcggctggctgctgggcaatggtggagtcggcggggccggcgggcagagcctgctgggcggggcaaccggcggggccggcggcaacgccggactgttcggggtcggcggaaccggcgggcccggcgggcccggcgggcccggcggggtcggcggtaccggtggtgccggtggcctgggcgggaccctctacggggccggcgggcacggaggtgccggcgggcccggcccgatcggtggtgtgggtggacacggcggtgtcgggggtgcggccgggctgttgggcgtgggcgggcacggtggtgccggcggacacggcgcggagggtgtggccggcgcagccggtgaggacttgtccccgcacggtacgtccggtggggtcggcggcgacgccggcgatggcggcaccggagggcggggcggctggctggccggcgccggtggggccggcggggccggtggggttggcgggaccggcggggccggcggggccggattttctcgtgccttgattgtcgctggggataacggcggtgaccccggcgccggcggggccggaggcaccggcggagccggctccacgatcggtgcccacggcgcggccggggccagccccaccagcggcggcaacggcggggccggcggcaacggcgcccacttctcatcgggcggcaaagccggcggtaacggcggggccggcggggccggcgggctggtcggcaatggcggcgccggaggtgccggcggcaacggcgcccccggtgccccgccttctggcggcgaccctaacggcggtggcggcggagctggcggcgctggcggtaagggcggcgacggcggagcccaagcaggcgacggcggtgctggcggcgccggcggtaagggcggcaacggcggcaacggcgccaccggcgccaccggccttaacggcctgggggcaggcgcggatggcaccgacggcggcaagggcggcaacggtggagccggcggtggcggtggagccggtgggcaaggcggtaaggcgcttgcagccacccaccaggacggcagcatgggtgccggcggggccggcggaaacggcggcgccggcggcatgggcggtgatggcggcaacggtgccaagggcacgttcgataacggcggcgatggagttggtggcaacggcggcaacggcggtagccgcggcatcggtggtgctggtgggatcggcggcgccggatccaccgcgggtgcagacggtgcccgcggcgccaccccgaccagcggcggcaacggcggcaccggcggcaacggcgcgaacgccaccgtcgccggcggggccggcggggccggcggcaagggcggcaacggcgggcttgttggtaatggcggggccggcggcaaaggcggggacggcatggccggtgtcgccggttcctcgcccaccaccgcgggcgaatccggcacgagcggccagaacggcggggctggcggggcgggcggggccggcggccggggcggagacttcgggggcgacggcgggaccggtggggccggcggcaacggcgccaacggcgccaacgccaccacgccgggcgccaagggcggcgacggcggccacggcgggcccggcgcgcaaggcggtaacggcggccaaggcgggcccggcggtttggcggggaacctctttggccagaacggaatccagggtgtcggcgggtccggcggcaaagggggggccggcgggctcgccggtgacggcggcaacggcgccaacggcaacttcgccttcggcgatggtaacggcggtcacggcggtaacggcggtaaccccggcgccggcgggcagggcggtagcggtggcgccggctctaccccaggcgccaagggcgcccacggcttcactccaaccagcggcggcgacggcggcgacggcggcaacggcggcaactcccaagtggtcggcggcaacggcggcgacggcggcaatggcggcaacggcggcagcgccggcacgggcggcaacggcggccgcggcggcgacggcgcgtttggtggcatgagtgccaacgccaccaaccctggtgaaaacgggccaaacggtaaccccggcggcaacggtggcgccggcggggccggcggggccggcctgaacggcggtaacggtggcgccggcggcaacggcggcctcggcggattcggcggcaacggcgccgccggtgccaacggcgtggccgtgggtgcgcccggacaacccggcggtgccggcgggcacggcggcgccggcggcaacggcggggccggcggcaacggcggtcaaggcgtagtcagcgacggcgcgggcggtgccggtggggccggcggcgacggcggtgctcccggtgacggggccaacggcggcaacggccagggagcaggggccttcgccggcggcggcggcgggcgaggcggcgacggcggcaacgccggcaacgccggtgccggcggccccggcggcaccggctccaccgcaggcaaggcggggccggccggcagcatcctgcacgacggcggcaacggcggtcacggcggccacggcgctgccagcggcggaaacggcggccccggcggccacgggggtaacggcggtaacggcggcaccggcgccaacggcggcaacggtggcatcggcgggactggcggcgccggcagcaccggcgccaagggcgtcctcggcaccaacgagggcgatggcggtgacggcggcagaggcggcaacggcggcagaggcggcaacggcggccaaggcctcaccggagccggcggcaacggtgggaccggcgggacacccggcaacggcggcaacggtggcaacggcgccagtggcgaccttgtcacctcacctggtgacggcggcggcgggggccgcggaggcgatgcaggacgcggaggcgatgcaggacttggcggttccagcggcccaggtggcacccccggcgactggggcaccggcggcaccggcggcaccggcggcaccggcggccagggtgccaacggcggcctcaccggcggcagaggcggcactggcggcaacggcggcaacggtaacaccggcggcaccggcggcgctggcggcaccggcggcaccggccacaacggctctcagcctgggatgggtggcaacggaggtgcgggcggctttggcggcaatggttttgccggcgtcggtggccggggcgggatgggtggctccgggggcaccggcggcaccggcgacgcggggccctttggaacaggcaccggtgggaccggtggccacggggggcagggcggtggcggcggcttcagcatcctccttggtctcggcggtctcggcggcctcggtagcccggggtccatcgccacaggtaccgccggcggcgccggtggcggcggtggcttcggcgggctcggcggcggcgaattcgtgtag

SEQ ID NO: 521 - DNA, 4983 bp, Mycobacterium tuberculosis H37Rv
atgtcatatgtgatcgcgacgccggagatgatggcaactgcggcttttgatctggcgcgtattggttcgcaggtgagcgcggctagtgcggtcgcggcgatgccgacgacggaagtggtggccgccggcgccgacgaggtgtcggcgggcatcgcggcgttgttcagcgcgcacgctcaggagtatcaggcgctaagtgcgcaggccgcggcgtttcacgaccagttcgtgcacacgctgaccgcggccgcgaggtggtacacggccaccgagatcgccaacgccgcggcgatgcgagtcgtgctcggagccgtgaatgcgcccacccagacgctactgggacgcccgctgatcggcgatggtgcgcacgggacagcgcctgggcagcccggtggggccggtggattgttgttcggcaatggcggcaacggcgctgccggtgccgtcgggcaggtgggcggcgccggcggggcggccgggttatttgggatcggcggcgccggtggcgcgggcggggcgggcgcacccggaggtaccggcgggacgggtggatggctggcgggtgggggcggcgtcggcggtatgggtggggctggtggtggcgccggcggggcgggtggcaacgcgggcctgttcggcaacggcggcgccggtggtgccggtggggctggtggtggcgccggcggcgcgggcggtaacgcggggtggtttggtcatgggggcgctggcggcgtgggtggtgtaggtgcggccggggccaacggtgctacgcccggtcaggatggggcggctggtgttgccgggtcggacgacggtgccggcggtgacggtttggcagggtcggacgggggcgatggcggtgccggtggggtgggcggcaacggtggtcggggagggtggcttctcggtaacggcggcgccggtggcgttggcggtgtcggcggggccggtggtgccggtgcggccggcggtgccggcggtgccggggctaccggaataaatgggccggccggtatctcggcggccggcggtgacggcggcgccggcggcaatggcggtgccggcggaaacggcggcgtgggcggcgccgggggtgctggcgggtcggctggactattggggtatgtcggccgggccggagacggcggggctggcgggggtggggggctgggtggagcgcctggtgacggcggtgccggcggcaacggtggcagttggctggccgccggtgacggcggggccggcggtcacggtggcgacccgggcctgggtggggctggcggagccgggggggcgtcgggcggcgccggtgctcgcgcgggggccaatggtctggcggccggcaacgacgggccggtcagcggcggcaacggcggcaaaggtggcaatggcgcccacgcaccggtcgccggcggtcatggcggtaacggcggtgccggtggcaacggcgggttggtcggtgacggtggggccggcggtcatggcggtgacggagccgcgggtgccggctatgccgatatgacggcgatcttcctgggttcatccggtacccccggtgaggatggaggtaacggcggggccggtggggccggcggcgcgggtggggcccacgccggcgatggcggggccggcggtgccggcggcaacggtggggccggcggggccggtggtaacggagctcacggtttcaatgctgtgctcgtatctgacggcggcaacggtggtgatggcggagccggcggtcgcggcggtgacggtggggccggtggggctggcggtgacgcacctgcgggtcgggcgggcagccagggtgttggcggggacggtggtgccggcggggctggtggggcgcccggtaacgggggcagcggtggccgcggcgacatggctttcaaggatggtgacggtggggccggcggcgatggtggtgacccaggcgccggtgggaagggtggcgccggcggcgccggcgccaccgagggtgtgaccggcgcgaccggcgctaccgtgcacagtggtggcaacggcggcaagggcggtaacggcgccgacgccaccgtggctggcgcgaacggcggcaagggcggtgccggtggtaacggcgggttggtcggtgacggcggggccggcggcgacggtggtagcggcgcggccggtgcgaatggcgcgaacgtaggtgaggacggcgccgacggcaccctctcggggcaaccgggcgaaggaagcgaggccaacggcggtcaaggcggcgttggcggtggcggcgcgggcggtgccggcggtgacggtggtgccgggagttcggcgttaggtagtggcggcaacggcggtcgaggcgatgcggggcaggccggcggcgcgggcggtgccggcggagccggtggcgccggtgggtcggtgtcgggcgacggtggacccggtggcaagggcggggccggcggtgcgggtggtgccggagctagtggtggcggcggcggcaagggcgcctccggcgccgacagcgctgaggccgttggaggcgccggcgggaaaggcggcgacggcggtgtcggcggcgttggcggtgacggcgggcccggcggtgatggcggcgccggcggggccgcacccgcgggtcaggtcggcagccacggtgtcggcggcgttggcggtgacggcgggctcggcggagccggcggcaacggcggtgacggcggtcatggcagtgatggcggggacggcggtgacggcggtgaccccggcgcgggaggcctcggcggcttgggcggcgacagcggcaacggcacccgcgcggccagcggtgtggacgccagcgaccacgggcccggcagcggcggcaacggtggtaacggtggcaacggtgcgcaagccagcgtcgcgggcggcgccgggggcaacggaggcgacggcggcaatgccggccgggtcggcgatggtggcgccggcggcaatggtggcgatggcgcggccggcgccaacggggccaattcgggcgcgcctggttcagatgccctcgccctcggccaaccgggaggcaacgggggtcagggcgacgcggggcaggccggcggtgccggtggtgccggtggtgccggtggcgccggtgggtcggtgtcgggtgacggcggtgccggcggcaacggcggggccggcggcaacggcggtgtgggcgctagcggtggggccggggccaggggcgccaacggtatcgacagtatcggcggcaccggtggggccggcggtggtggcggcgatggcggtgccggcggggtcggtggacatggcggggacggtggggtcggcggggccgcaccttcggggacggtcggcagtcacggcaccggtggggtcggtggcgacggcggactcggcggcgccggcggcgttggcggggccggcggcaacggcggcattggtatcaccgtcggcggcgccggcggagcgggcggtaacggcggtgaccccggcgcaggcggtcgcggcggtctggggggtgacagcggcaacggcacctccgcggccaacggcgtggacgccagcaaacacgggccactgaccggcggcgacggcggcgtcggcggcaacggtgccaaggccgccgcggccggcggcgacggcggccagggcggtgacggcggcaacgccgggctattcggggacggcggagccggtggtgatggggccgacggcaccgctgccgaagctctcggcggtgatggcggggccggtggggctggaggcaagggcggtgacgccggcgacatcggtgacggcggtgacggcggcaagggtggcgacggcgcgcacggtgccctcggagggctcaccgttgctggcggcaacggtggggctggtggcgccggtggggctggtggcgccggcggagcatttctgggcgacggcgggaacggcggagccggcggccaaggtggggctggccggggcggcagccccggcggcggcggcggggttggtggacacggcggggcgggcggcgacgccgggatgaacggcggcggcggaaccggcggccagggaggcaacggcgcggccggtggcgcgggttggtcgcccgactccgacctaaagggcttcgacggcttcgacggcggcagcggtggggcgggaggcgacggcggggccggtggcgccggcggaactcagaccggcgacggtggtgacggcggggccggaggcctaggcggggctggtggggtcggcggtaacggcgttgacggctttgacattaacgaaacgacgggccgcgacggcggcgacggcggcgacggtggctacggcgggtggggcggcgccggcggaaacggcggggccggcgggtcggcacccgccggcgaggtcggcaatcgaggcgttggcggggacggcggtgacggcgggtcgggcggggacgctggtaatggtggcttgggcggtgacggctttacctatctcgcggattttgacggagagcctggcggcgacggaggtgacggcggcgacggcgggtggggccgccccggcggacaaggcggtttcggttccacaagtggcgcgcacggcaaggccggcttcggcgcccccggcggtgacggaggcgacggcgggaacggcggtcacggtggggacggcaacggcagctttgctgatgcaggcgacggcgggccgggtggcaacggcggcaacggcggcttgggtggggccgggcgagacggtggcgcccccggtggtgacggaggcgacggcgggaccggcggctccggcggcttcggcgcccctccgcctcgcagcatcggcggcggtgacggcggggacggcgggcgcggaggtgacggcggacgcggtgccggtggcttgacctccggcggcgtcggctcgtcgggcgagtcgggtggctccggcaacgggaggggcgaccctggctccggcggttccggcggtgaaggcggcgaaggcggcccctccatctccgttaacgtcacgtag

SEQ ID NO: 522 - DNA, 4146 bp, Mycobacterium tuberculosis H37Rv
atgtcgtttgtgttggtttcgccggagaccgtggcggcggtggccacggatctcaagcgcatcggcgcctcgctggcccacgaaaacgcgtcggcggccgcttcgacgacggcggtggtctccgcggccgccgacgaggtatcgacggcggtcgccgctctgttctcccaacacgcccagggctaccaagcggcggccgctcaggtagcagcgtttcatagccggtttgtgcaagccctgacggccggtgccggggcgtacgcatttgccgaggcggccaacgcgtcgccgctacagtcagccatgggtgcggtaagcgcgtctgcgcagacgctgttgtcgcgcccgttgatcggcaatggcgccaatgcgacgacgccgggcggtaacggcggcgacggcggatggctattcggcagcggcggcaacggcgcgcccggcgcggcgggccagtccggcggtaacggcgggtcagccggactgtggggtaacggcggcgcgggtggcgccggcggcagcggcggcgccgccggcggcaacggcggtaacggcgggtggctgttcggcgccggcggcaccggcggtatcggcggcaccggtgctcccggcgccatgggcggcaccggcggcaacggcggcaacggcgcgctgctgatcggcggcggcggcctcggcggcgccggcggcatgggtggcaccggcggcggcaccggcggcaccggcggcaacggcggcaacggcgcgctgctgatcggcgctggtggtgtcggaggtgctggcgggatcggtggccagggtaccggcgccggcggtgccgccggcgccggcggcaccgggggcaacggcggcgccggggggttgttcatgaacggcggcgacggcggcgccggcggtcaaggcggcgacggtgcggccggcgacgcggctgccagcgccggcggcaccggcggcaaaggcggccaaggcggcgacggcggcaccggaggggccggcggcgcaggcccagtgctgttcggccacggcggcgccggcggcatgggcggccaaggcggcaccggtggaatgggcggcgccggcggagacggcaccaccgtcatcgcggccggtaccgggggggagggcggcaccggcggcgcggccggcgccggcggagccgcaggcgctcgcggggctctcaccagcggcggcctagccggcggcgtcggggccggcggcaccggcggcaccggcggtaccggcggcaacggcgctgacgccgctgctgtggtgggcttcggcgcgaacggcgaccctggcttcgctggcggcaaaggcggtaacggcggaataggtggggccgcggtgacaggcggggtcgccggcgacggcggcaccggcggcaaaggtggcaccggcggtgccggcggcgccggcaacgacgccggcagcaccggcaatcccggcggtaagggcggcgacggcgggatcggcggtgccggcggggccggcggcgcggccggcaccggcaacggcggccatgccggcaacacaggtgacggcggcgacggcgggaccggcggtaacggcggcaacggcaccggaggcgtgaacggcgccgacaacaccctcaaccccgacacccccggcggcgccggggagcccggcggggccggcggggccggcggggccggcggggccgccggcggcccgggcggtaccggcggtaccggcggtaacggcggcaacggcggcaacggcggcaacggcggcaacggcggcaacggcggcaacggcggcaatgccggcaacaacagcaccaatgccccagtcggtggcgaaggcggcgccggcggcgacggcggcgccggcggcgcaggcggggccgccaacggcggcaccgcgggcagccagggcactgggggcgtcggcggcgacggcggcgcgggcggcaacggcggcggcggcaaggctggcaccggcaacagcggcaactttggggtggacggcgaagccggcttcagcggcggcgccggtggcaacggcggcgtaggcggggccgccggcgccaatggcggaaccggcggcagcggtggtaatggcggtgacggcggtgcgggaggcattggcggggccggcggcaacggcataccgggcactggcacagagcctgccgggggcaccggcgccaaaggtggagacggcggcgacggtggcgccggcggcgcaggcggcaatgccggcggggccggcggccagggcggcaatgccggccagggtggcgccggcggtgcgggcggcaacgccgtgattcccggcgacggcgtcgggaaggcgccgcacggcgacgcgggcggcagcggcggagacggcggcaaaggcggccagggcggtagtggcggcaccggcggatccggtgccccgatcggtggcggcgccggaggcaccggagggtccggcggacacgccggcaagggtggcgccggcggcatcggcgcacagggcaccaccatcaccgtgcccgggaacggcggcaacgccggcgacggcggcaacggcggcaacgccggcgccggtggaaacggcggctccggcgacttcggtggcaataccaccagcggcgcctccggcagcggcggcaacggcggcaacgccggcaccgcgggtagcggcggtgcgggcggaaccggcggcaccggccttagcggcggcaacggtggcaacggcggcaacggcggcaacggcggtgacggcggtaacggcgcccacggcaccgtcggcgcccagttcgtcccggccaccagcttgcccacacccaacggcggggccggtggcaacggtggcaccggaagcaacggcggcgcgcccggccccgccggggcgcccggccccactaccggcggtaacgctggcagccagggcatcggcggcgacgggggcaacggcggcgacggcggtaaaggcggtgacggcgccgacgctgtcaacgtcgtattcatgccgactgagccacaggccgcgaccggcactgccggcagcgccggtgaccccaccggcggtaacggagggcccggcactcccggcagccccatggttgccccgcccccgccaacgccaatcactcaagtccaacagggcggtgacggtggcgccgggggcaccggatccaccaacgccaacgacggcacagccaccggcggaaagggcggagaaggcggagtcggcagcattctcggcgggcccggcggcaacggcggaactggcggcaacgcctcggcaaccggcaccaacggggtggccaacgccgggaatggcggcaagggtggcgacggcggccagtttggggccggcggcaacggtggtgccggcggcagcgtaaccgacggatccgccggcagcaccgcaggcaacggcggcaacggcggcaacgcaaccaacggcaccatcgcaggccaacccgccggcggcaacggctcggccggcgggaaaggcggcgacggcggcaacatcgccgccggtgccaccggcaccgccggcaacggcgggaacggcggcaacggcaacgacggcgccgtcaacgccggcaccggcggctccggcgggaacggcggtaacgccggtggcggcggcgccaatggcggcgacggcggcgccggcggcgccggcggggccggcgggcgtggcggcaagggcatcgacggcgggttcggcggtgacggcggcaacggcggcagcaacaacggcaccggcgccggtggcaacggcggcaacggcggcaccggcggggtcggctcggttggcgcggctggtggcgatggcggcaacggcggcaccggcggcttcgccggtttcggcggcaccgcaggcaatggcggttccggcggcacgggcggggccggcggcgacggcggcaccggcggggacggcggcaacggcgttatcgccggcggcggggggaccggcggcaacggcggcgccagcggggccggcggcgccggcggcacgggcgggttcgccggcaacggcaatgccggcggcaatggcggcaccggcggcgcgagcgaggacggcgacaacggcaacgctggcagcggcgccaccggcggtaccggcggcaacggcggcaccggcggcgacggcggcgctgccgggctgggcggcgtcgcgtga

SEQ ID NO: 523 - DNA, 3921 bp, Mycobacterium tuberculosis H37Rv
atgtcgttcgtaatcgcgacgccggagatgctgaccacggcggcaacggatttggcgaaaattggttcgacgatcactgcggccaacaccgcagcggccgcggtggcgaaagtgctgcccgcgtcagccgacgaggtgtcggtggccgttgcggcgttgttcggcacgcacgcccaggaatatcagaccgtcagcgcccaagtggcgacgtttcatgaccggttcgtgcagaccctgtccgcggccgcgagctcgtacgtggccgccgaggcggtcaacgttgaacagagtttgctagccgcggtcaatgcgcccacccaggcgctgttcggacgcccgctgatcggcaacggcgccgacggctcccccgggaccgggcaggccggcgggccaggcggcatcttgtacggcaacggcggcaacggcgggtctggggcgccaggacaacgaggcggggccggcggggcggcgggcctaatcggtaacggcggcaacggtggagccggcggcgtgggtaccaccggcggggccggtggtcacggcggcgcgggcgggtggctgtatggcaacggaggcgccgggggttttggcggggccggggcggtcggcggcaacggcggggccggcggtaccgccgggttgttcggtgtcggcggggccggtggggccggaggcaacggcatcgccggtgtcacgggtacgtcggccagcacaccgggtggatccggcaccgctggcggggccggcgggatcggcggcaacggcggggccggcggggccggcggggtgctgatgggcaacggcggcaacggcggggccggcggcgagggcgggcccggcggcgccggcggtgcgggcgccagcggcgcccacgccaccaacttgggcgctgacggtcaagccggcggaaacggcgggaatggtggggctggcgggaccggcggggtcggcgggcccggcggcggccacggtctgctcggcctcggcggcagccacggcgccggcggggctggcggtagcggcggtgacggcggagctcccggtgacggcggcaacggcgctaccgggacgtggggtcacaaccttggtgccggcgggaccggtggcaatggcggcaacccgggcgccggtggggccggtggcgccggtggcgccagcgtcggcggcagcgcgcatggcgcgaacggcgcgcccggcaccacctccaccagcggtggtaacggcggcgacggcggcaaaggcgccgacgctatcagcagcggacagaccggcgcgaacggtggcaggggtggcgacggcggtcaggtgggtaatggcggtgccggtggggccggtggccgcggcggggccggcggtctcggatttggatccgaagcgcccggtcgccccggcggggccggcggcaccggcggggccggcggcaacggcggaactcaggccggtgacggcggcaccggaggtgctggcggggccggcggcgatggcggatccggaggtgctggcagcatcggcttcaatgcgtccgctcccggggccgcaggctcacccggcgggaatggcggtaacggtgggcctggcggagccggcggcgagggcggggccggcggtctcgcgttggccgcctcgggccagaacggcagccagggcgctggcggtgacggcggagccggcgggaacggcgggactcctggcaacggcggtcacggcgccgccggcgcgctcggtgtcaacggtggtgtaggtggcgccggtggccacggcggtgatcccggtgtcggcggtgccggcggccagggcggaagcggctccacccccggtgccaacggcgcacccggcaacacccccaccagcggcggcaacggcggcaacggcggcagaggcgccgatgccaccggctttggccagaccggcgcgtccggcggcaggggcggtgatggcggtttggtcggcaacggcggcgccggcggcgccggcggcaacggcagcaaaggcctgcccggtctgggcaggctcggcaaccccggcctggatggcggcaccggcggaaacggtggggccggtggatccggcggcgcctgggcgggcaacggtggcaccggcggggccggcggcaccggcggcgtcggcgggactggagggtccggcagcgacggtgtcaacggttccagcgcgggcgcggacgggcaccccggcggcaccggcggagttggcggtaccggcggaaaaggtggggacggcggggacggcggggccgcacccaacggcgtcgccggcagccaaggccccggcggtgccggcggcgacggtgggaccggcggagttggcggtaacggcggccgcggcattgacggcgccgacggcgccaccgcgggtgcccgcggccaggatggcggcgccggcggggccggcggaaagggcggccgaggcgggaccggcgggccgggcggggccgggccggcgggcacaaccggcagccaaggcgccggcggcaacggcggcagcggcggcaccggcggggaccccggtgacggcggcaacggcgctaacggcagcgtgttcaccaacaacggcatcggcggcaacggcggcaacggcggcaacgccggccccagcggggccggcgggagtggcggcgccggctccactttcggtgcgaccggctcaagcagcagcattcatgtcaacggcggcaacggcggcaacggcggcaacggcgaccatgccctcagcggcaacggcgcggccggcggcaacggcggcaacggcggcaacggcagcctgcgcggcagcggtggggccggcggccacggcggcaacggcggcaatgccagcaggggcatgggcggtgacggcggaaccggtggcgccggcggaaacgccgggcagattggcaacggcggagcgggcggcaatggcggagacggcggcaccggtagtgacggcaatcccggagccattaccggcagcggcggccgcggcggcgacggcggcgtaggcgggcaaggtgggagcgtcgccggcgacggcgctgacggcggccggggcggggccggcggcacgggcgggacgggcctgcggggcaccaccggcgccaccggtgcgaccggcacattcgacgctggcgcggacggtcacggcggtaacggtggcaccggcggggttggcgggaccggcggcgccggcggcggcggcggcaacggcggggccggcggcaaagcgctgtcgccaacgggcaacaacggcagccaaggcgccggcggagatggtggggccggtggcgccggcggcaccggcggcaccggcggcgacggcggcagaggtgcccacggcactctcttcagcagcctcgctggcactggcgggactggcggaaatggcggcaccggcggcaccggcggcaccggtggtgccggcggtgccggcgggaccggttccaccctgggcgcgaccggtgcgacaggggcggccggccgcgccggaaacggtggcgtcggcggcagtggcggccttggctccgcctttggccccggcggcaccggcggcatgggcggcgccggcggcaccagcaccgtcagcgccggcggtgacggcggaaggggcggcttcggcggcgacggccttgatgccagttccggtgggaatggcggggacggcgggcacggtggcgacggcttcaggaccgctggggcgggcgggcgaggtggggacggcggcaaaggggccgaccccggcggtttattcccgatccctggggctggcggtaagggtggcaccggtggcaccggcggcaccgcacacctcgggcccctggccatcatcggccaatccggccagcccggccagttcggcagccccggcgccgacggccgcggcggggccgggggcgcaggcgggggcggcggcgccggcggcagcttctag

SEQ ID NO: 524 - DNA, 4311 bp, Mycobacterium tuberculosis H37Rv
atgtcggcggccgcggtcgcctgggaccaactggcgatggaattggcctcggcagcggcctctttcaactccgtgacgtcgggcctggtcggcgaatcgtggctcggaccgtcatcggcggcgatggccgctgcggtagcgccgtacctaggatggcttgccgcggcagcggcccaggcccagcggtcggcaacccaagccgcggccctcgtggccgagttcgaggctgtccgggcggcgatggtgcaaccggcgctggtggcggccaaccgctccgacctggtgtcattggtgttctcaaacttcttcgggcagaatgctccggcgatcgctgcgattgaggccgcatacgaacagatgtgggccatcgatgtgtcggtgatgtcggcctaccatgccggggcatcggcggtggcgtcggccctgacgccgttcactgcgccgccgcagaatctgacagacctgcccgcccagttggcggccgctccggcggccgtcgtcaccgcggcgatcaccagttccaagggtgtgctggcaaatcttagcttaggcctggcaaactcgggcttcggacagatgggcgccgctaaccttggcattttgaacttgggcagcctaaatcccggcggcaacaacttcggccttggaaatgtcggcagcaacaacgttggcttgggcaacaccggcaacggaaacatcggcttcggcaacacgggcaacggaaacatcggcttcggcctcaccggcgacaaccagcaggggttcggcggctggaactcggggaccggcaatatcggcttgttcaactcaggcaccggcaacatcggcatcggcaatacgggcaccggaaacttcggcatcgggaactcaggtaccagctacaacacgggtatcggcaacacgggccaagccaacacgggcttcttcaacgccggcatcgccaacactggcatcggcaacacgggcaactacaacacgggcagcttcaatctaggcagcttcaacacgggcgacttcaacacgggcagctccaacacaggcttcttcaaccccggcaacctcaacaccggcgtgggaaacaccggcaacgtcaacaccggtggattcaactctggcaactacagcaacggcttcttctggcgaggcgactaccagggcttgatcggcttctccggcacactgaccattcccgctgctggcctagacctcaacggcctcggctccgtcggccccatcaccatcccgtccatcaccattcccgaaatcggcctgggcattaacagttccggagcgttggtggggccgatcaatgttccgcctattactgttcccgccatcgggctgggcatcaacagtaccggggcactcgttggccccatcaacatcccgccgatcactctaaattctattggcctagagctatcggcgttccaggtcattaacgtgggatcgatttcgatccccgcgtctccgcttgcgatcggcttattcggcgtaaatcccaccgttggcagcataggcccgggtagcatatcgatacagctaggcactcctgagattcccgcgattccgccatttttccccggattccctccagattacgtgacagtgagtggtcaaatcggtcccatcaccttcttatcgggtggttatagtttgccggctattccgttgggtattgatgtgggtggagggttaggcccgtttacggtgttcccggatggctactcacttccggcaatcccgttgggtattgatgtgggcggagggttaggcccgtttacggtgttcccggatggctactcacttccggcaatcccgttgggtattgatgtgggcggagggttaggcccgtttacggtgttcccggatggctactcacttccggcaatcccgttgggtattgatgtgggcggcgccatcggccccctcactaccccgccaatcacgatcccctcaatcccgttgggcatcgacgtgtccggcagcctcgggccgatcaacatcccgatcgaaatcgcgggcaccccaggcttcggaaactcgaccaccaccccgtcatcgggcttcttcaacagcggtacgggcggcacatcgggtttcgggaacgtcggttcgggcggatctggcttctggaacattgctgggaatctcggcaactccggattccttaacgtcgggccactgacatcgggaatcttgaacttcggcaacacagtctcaggcctctacaacaccagcacgctgggcctagcgacatcggcctttcactccggcgtcggtaacaccgacagccaactcgccggcttcatgcgcaacgccgcaggtgggacgttattcaacttcggcttcgccaacgacggcacactcaacttgggcaacgcaaacctcggcgactacaacgtgggtagcggaaacgtcggtagctacaacttcggtagcggaaacatcggcaacggaagtttcggtttcggaaacatcggaagcaacaacttcggttttggaaacgtcggcagcaacaaccttgggtttgcaaacacgggtccggggttgacggaggccctgcacaacattggctttgggaacatcggcggcaacaactacggcttcgcgaacatcggtaacggcaacatcggcttcggcaacacgggcactggaaatattggtatcgggctcaccggcgacaatcaggtcggattcggggcgctgaactccggcagcggcaacatcggcttcttcaactccggcaacggcaacatcggcttcttcaactcaggcaacggaaacgtcggcatcggcaactccggcaactacaacaccggcctgggtaacgtgggcaacgccaacacgggcctgttcaacaccggcaacgtcaacactggaatcggcaacgcaggaagctacaacacaggcagctacaacgccggcgacaccaacacgggcgacctcaacccgggcaacgccaacacggggtacctaaacctcggcgacctcaacaccggctggggaaacattggcgaccttaacaccggcgccctgatctcgggcagctacagcaacggcatactgtggaggggcgattaccagggtctgattggctactcagacacactcagcattcccgccatcccactgagcgtcgaagtgaatggtggcatcggtccgattgtggtgccggatattactattcctggtattccgttgagcctgaacgcgctgggtggtgtcggtccgattgtggtgccggatattactattcctggtattccgttgagcctgaacgcgctgggtggtgtcggtccgattgtggtgccggatattactattcctggtattccgttgagcctgaacgcgctgggtggtgtcggtccgattgtggtgccggatattactattcctggtattccgttgagcctgaacgcgctgggtggtgtcggtccgattgtggtgcctgatattactattcctggtattccgttgagcctgaacgcgctgggtggtgtcggtccgatcaccgttcccggcgtccctatttcccgcatcccccttacgattaacatcaggataccggtcaacatcactctcaacgaacttccgtttaacgtcgctggtatcttcacgggctacatcggccccatcccgcttagcacattcgtattaggcgtcacgctggccggcggcaccctggagtctggcatccagggattcagtgttaatccgttcggtttgaatattccgctgagcggtgctaccaacgctgtcacgatccctggtttcgcgattaatccgtttgggttgaatgttccgttgagcgggggcacgagcccggttacgatccctggtttcgcgattaatccgtttgggttgaatgttccgttgagcgggggcacgagcccggttacgatccccggcttcaccattcccggatcccccctgaacttgaccgccaacggcggcttgggaccgatcaacatcccgatcaacatcacgagcgccccgggcttcggaaactccaccaccaccccgtcttcgggcttcttcaacagtggcgatggaagcgcatccggcttcggcaacgtcgggcccggcatttcgggcctctggaaccaggtgccgaacgcgctgcaaggcggagtctcgggaatctacaacgtcgggcagctggcgtcgggcgtggcgaacctaggcaacaccgtctcgggcttcaacaacacgagcaccgttggtcacctcaccgctgcgtttaactcgggcgtcaacaacatcggccaaatgctcctgggcttcttctcaccgggtgccgggccgtaa

SEQ ID NO: 525 - DNA, 11151 bp, Mycobacterium tuberculosis H37Rv
atggagtttccggtgttgccaccggaaatcaactccgtgctgatgtattcgggtgcggggtcgagcccgttgctggcggcggccgcggcgtgggatgggctggctgaggagttggggtcggcggcggtgtcgtttgggcaggtgacgtcgggcctgacggcgggggtgtggcagggtgcggcggcggcggcgatggcggccgcggcggcgccgtatgcggggtggttgggttcggtggcggccgcggccgaggcggtggccgggcaggcgcgggtggtggtgggggtctttgaggcggcgttggcggcgacggtggatccggcgctggtggcggccaaccgggcgcggctggtggcgttggcggtgtcgaatctgttggggcagaacacgccggcgatcgcggccgccgaggccgagtacgagctgatgtgggccgccgatgtggcggcgatggccggctaccattccggcgcgtcggctgctgccgcggcgttgccggcgttcagcccaccggcgcaggcgctggggggaggtgtcggcgcgttccttaccgccctgttcgccagccctgcgaaggcgctgagcctgaatgcgggtttgggcaatgtcggcaattacaacgtcgggttgggcaatgtcggggtgttcaacctgggcgcgggcaatgtgggtgggcagaatctgggtttcgggaatgccggtggcaccaatgtcgggttcggcaacctcggtaacgggaatgtcgggttcggcaactccggtctgggggcgggcctggccggcttgggcaatatcgggttgggcaatgcgggcagcagcaactatggtttcgcaaacctgggtgtgggcaacatcggtttcggcaacaccggcaccaacaacgtcggcgtcgggctcaccggcaaccacctgacgggtatcgggggcctgaattcgggcaccgggaatatcgggttgttcaactccggcaccgggaatgtggggttcttcaattcggggaccgggaacttcggggtgttcaactcgggtaattacaacaccggtgtcggtaatgcggggacggccagcacggggttgttcaatgccggcaatttcaacaccggcgtggtgaacgtgggcagttacaacaccggcagtttcaacgccggcgacaccaacaccggtggcttcaaccccggcggtgtgaacaccggctggctgaacaccggcaacaccaacaccggcatcgccaactcgggcaacgtcaacaccggcgcgttcatctcgggcaacttcaacaacggcgtgctgtgggtgggtgactaccagggcctgttcggcgtctccgccggctcgtcgatccccgcaattcccatcggcctggtgctcaacggcgacatcggcccgatcaccatccagcccatcccgatcctgcccaccatcccgctcagcattcaccaaaccgtcaacttgggcccgctggtggttcccgacatcgtgatccccgccttcggcggcggtatcggcatacccatcaacatcggcccgctgaccatcacacccatcaccctgtttgcccaacagacatttgtcaaccaattgccctttcccaccttcagtttagggaaaatcacaattccacaaatccaaacctttgattctaacggtcagcttgtcagctttatcggccctatcgttatcgacaccaccattcccggacccaccaatccacagattgatttaacgatcagatgggatacccctccgatcacgctgttcccgaatggcatcagtgctcccgataatcctttggggttgctggtgagtgtgtcgatcagtaacccgggctttaccatcccgggatttagtgttcccgcgcagccgttgccgttgtcgatcgatatcgagggccagatcgacgggttcagcaccccgccgatcacgatcgatcgcatccccctgaccgtggggggcggggtcacgatcggccccatcacgatccagggccttcatatcccggcggcgccgggagtggggaacaccaccacggccccgtcgtcgggattcttcaactccggtgcgggtggggtgtcgggtttcggcaacgtcggcgcgggcagctcgggctggtggaaccaggcgccgagcgcgctgttgggggccggttcgggtgttggcaacgtgggcaccctgggctcgggtgtgctcaacctgggctcagggatctcggggttctacaacaccagcgtgttgcctttcgggacaccggcggcggtgtcgggcatcggcaacctgggccagcagctgtcgggggtgtcggcggcgggaaccacgctgcgctcgatgctcgccggcaacctcgggttggccaatgtgggcaacttcaacaccgggttcggaaatgtcggggacgtcaacctgggtgcggccaacatcggtgggcacaacctgggcctgggcaatgtcggggacggcaacctggggttgggcaacatcggccatggcaacctggggtttgccaacttgggcctgaccgccggcgcggcgggggtgggcaatgttggttttggcaatgccggcatcaacaactatggcttggcgaacatgggtgtgggcaatattgggtttgccaacaccggcacgggcaacatcgggatcgggctggtcggggaccatcggaccgggatcgggggcttgaactccggcatcggcaatatcgggttgttcaactccggcaccggcaacgtcgggttcttcaattccgggaccggcaacttcggcatcgggaactccggccgcttcaacaccgggatcggtaatagcggaacggccagcaccgggctcttcaatgccggcagcttcagcaccggcatcgccaacactggtgactacaacacgggcagcttcaacgccggcgacaccaacaccggtggcttcaacccgggcggcatcaacaccggctggttcaacaccgggcatgccaacaccgggttggccaacgcgggcaccttcggcaccggcgccttcatgacgggcgactacagcaacggcctgttgtggcggggcggctacgagggcctggtcggcgtccgcgtcgggcccacgatctcccaattcccggtcaccgtgcacgcgatcggcggggtgggcccgctgcatgtggcgcccgtcccggtacccgccgtgcacgtcgagatcaccgacgccaccgtcggcctgggtccgttcaccgtcccaccgatcagcattccctcacttcccatcgccagcatcaccggaagcgtggacctggccgcaaacaccatctcgccgattcgcgctcttgacccgctcgccggttcgatagggctttttctcgagccgttccgcctcagtgacccatttatcaccattgatgcgttccaagttgttgccggtgtcttgttcctagagaacatcattgtgcccggcctcacggttagcggtcagatattggtcaccccgacaccaattcccctaaccctcaacttggacaccaccccgtggacgcttttcccgaatggtttcaccattcccgcgcaaacccccgtgacggtgggtatggaggtcgccaacgacgggttcaccttcttcccgggtgggctgacctttccgcgggcctccgccggggtcaccggactgtccgtggggctggacgcgttcacgctgttgcccgacgggttcaccctcgacaccgtgccggcgaccttcgacggcaccatcctcatcggcgatatcccgatcccgatcatcgatgtgccggcggtgccggggttcggcaacaccaccacggccccatcgtcggggttcttcaacaccggcggcggcggtggatcggggttcgccaacgtcggcgcgggcacgtcgggctggtggaaccaggggcacgacgtgttagcaggggcgggctcgggagttgccaatgccggcacgctgagctcgggcgtgctgaacgtcggctcggggatctccgggtggtacaacaccagcaccctgggagcgggcaccccggcggtggtctcgggcatcggcaacctcggccagcagctgtcggggttcttggcaaatgggaccgtgctcaaccggagccccattgtcaatatcgggtgggccgatgtgggcgcgttcaacaccgggttgggcaatgtgggggacctcaactggggtgcggccaacatcggcgcgcagaacctgggcctgggcaatctcggcagcgggaacgtcgggttcggcaacatcggtgccggcaacgtcgggttcgccaactcgggtccggcggtgggcctggccggcctgggcaacgtggggttgagcaatgccggcagcaacaactgggggctggccaacctgggtgtgggcaacatcgggttggccaacaccggcacgggcaacatcgggatcgggctggtcggcgactaccagaccggcatcggcggcctcaactcgggtagtggcaatatcggattgttcaattccggcaccggcaatgtcgggttcttcaacaccggcaccggcaacttcggactgttcaactccggtagtttcaacaccggcatcggtaatagcggaaccggcagtactgggctcttcaatgccggcaatttcaacaccggcatcgccaaccccgggtcgtacaacacgggcagcttcaatgtcggtgataccaacaccggtggtttcaacccgggcgacatcaacaccggctggttcaacaccggcattatgaatacgggcacccgcaacaccggcgccctcatgtcggggaccgacagcaacggcatgctgtggcgcggcgaccacgagggcctgttcggcctgtcctatggcatcacgatcccgcaattcccgatccgcatcaccacgactggcggtatcggccccatcgtcatcccggacaccacgatccttccgccgctgcacctgcagatcaccggcgacgcggactacagcttcaccgtgcccgacatccccatccccgccatccacatcggcatcaatggcgtcgtcaccgtcggcttcaccgccccggaagccaccctgctgtccgccctgaagaataacggtagcttcatcagcttcggccccatcacgctctcgaatatcgatattccgcccatggatttcacgttaggcctgcccgttcttggtcctatcacgggccaactcggaccaattcatcttgagccaatcgtggtggccgggatcggtgtgcccctggagatcgagcccatccccctggatgcgatttcgttgagtgagtcgattcctatccgcatacctgttgatattccggcctcggtcatcgatgggatttcaatgtcggaagtggtgccgatcgatgcgtccgtggacatcccggcggtcacgatcacaggcaccaccatttccgcgatcccgctgggcttcgacattcgcaccagtgccggacccctcaacatcccgatcatcgacatcccggcggcgccgggcttcgggaactcgacccagatgccgtcgtcggggttcttcaacaccggtgccggcggcggatcgggcatcggcaacttgggtgcgggcgtgtcgggcctgctcaaccaggccggcgcggggtcactggtggggacactctcggggctgggcaatgccggcaccctggcctcgggtgtgctgaactccggcaccgccatctccgggctgttcaacgtgagcacgctggacgccaccaccccggcggtgatctcggggttcagcaacctcggcgaccatatgtcgggggtgtccatcgatggcctgatcgcgatcctcaccttcccacctgccgagtccgtgttcgatcagatcatcgacgcggccatcgccgagctgcagcacctcgacatcggcaacgctttggccttgggcaatgtcggcggggtgaacctcggtttggctaacgtcggtgagttcaacctgggtgcgggcaacgtcggcaacatcaacgtcggcgccggcaacctcggcggcagcaacttggggttgggcaacgtcgggaccggcaacctcgggttcggcaacatcggtgccggcaatttcggattcggcaacgcgggcctgaccgcgggcgcggggggcctgggcaatgtggggttgggtaacgccggcagcggcagctgggggttggccaacgtgggtgtgggcaatatcgggttggccaacaccggcaccggcaacatcgggatcgggctgaccggggactatcggaccgggatcggcggcctgaactcgggcaccgggaacctcgggttgttcaactcgggcaccggcaacatcgggttcttcaacaccgggaccgggaacttcgggctgttcaactcgggcagttacagcaccggtgtggggaatgcgggcacggccagcaccgggttgttcaacgcggggaacttcaacaccggtctggccaatgccggctcctacaacaccggcagcctcaacgtgggcagcttcaacaccggcggcgtcaacccgggcaccgtcaacaccggctggttcaacaccggccacaccaacaccggcctgttcaacaccggcaacgtcaacaccggcgcgttcaactccggcagcttcaacaacggggcgctgtggaccggtgactaccacgggctggtcggcttctccttcagcatcgacatcgccggcagcaccctgctggacctcaacgaaaccctcaacctgggccccatccacatcgagcagatcgacatccccggcatgtcgctgttcgacgtccacgaaatcgtcgagatcggacccttcaccatcccgcaggtcgatgttcccgcgataccgctagagatccacgaatcgatccacatggatcccatcgtcctggtgcccgccaccacaattcccgcacagacgagaaccattccgctggacatccccgcctcacccgggtcaaccatgacgcttccgctcatcagcatgcgcttcgaaggcgaggactggatcctcgggtcgaccgcggcgattcccaatttcggagaccccttcccggcgcccacccagggcatcaccattcacaccggccctggccccggaacgaccggcgagctcaagatatctattccgggtttcgagattccgcaaatcgctaccacgagattcctgttggacgtgaacatcagcggtggtctgccggccttcaccttgttcgcgggtggcctgacgatccccacgaacgccatcccgttaacgatcgatgcgtccggcgcgctggatccgatcacgattttcccgggtgggtacacgatcgacccgctgccgctgcacctggcgctgaatctcaccgtgcccgacagcagcatcccgatcatcgatgtcccgccgacgccagggttcggcaacaccacggcgaccccgtcgtcggggttcttcaactccggcgccggtggggtgtcggggttcggaaacgtcgggtcgaacctgtcgggctggtggaaccaggcggcgagcgcgctggcggggtcgggatcgggggtgttgaatgtcggcacgctgggctcgggtgtgctcaacgtcggctcgggtgtctcggggatctacaacaccagcgtgttgccgctcgggacgccggcggtgctgtcgggcctcggcaacgtcggccatcagctgtcgggcgtgtctgcggccgggaccgcgttgaaccagatccccatcctcaacatcgggttggcggatgtgggcaacttcaacgtcgggttcggcaacgtcggggacgttaacctgggcgcggccaacctcggtgcgcaaaacctggggctgggcaacgtcggcaccggcaacctcggcttcgccaacgtcggccacggcaatatcggtttcggcaattcgggtctgaccgccggcgcggccggcctgggcaacacggggttcggcaatgccggcagcgccaactatggtttcgccaaccagggcgtgcgcaacatcgggttggccaacaccggcaccggcaacatcgggatcgggctggtgggggacaacctcaccggcatcgggggcctgaactccggtgccggcaatatcggcttgttcaactccggcaccggcaacatcgggttcttcaactccgggaccggcaacttcggcatcggtaactcgggcagcttcaacaccggcatcggcaatagcggaacgggcagcactgggctcttcaatgccggcagcttcaacaccggcgtggccaacgccggcagctacaacaccggcagcttcaatgccggcgacaccaacaccggggggttcaacccgggcaccatcaacaccggctggttcaacaccggccacaccaataccggcatcgccaactcgggcaacgtcggcaccggcgcgttcatgtcgggcaacttcagcaacggcctgttgtggcggggtgatcacgagggcctgttcagcctgttctacagcctcgacgtgccccggatcaccatcgtggacgcccacctcgacggcggcttcggacccgtggtcctcccgcccatcccggtgccggccgttaatgcgcacctgaccggaaacgtcgcgatgggcgcattcaccattccgcagatcgacatccccgcactcaccccaaacatcaccggaagcgccgccttccgcatcgttgtggggtccgtgcgcattccgccggtgagtgtcattgtggagcaaataatcaacgcctcggttggggcggagatgaggatagatcccttcgaaatgtggactcaaggcactaatggccttggtataaccttctattcattcggatcggccgacggttcgccctacgccaccggcccactcgttttcggcgccggcacgagcgacggaagccatctcaccatttccgcgtccagcggggcgtttaccactccgcagctcgaaactggcccgatcacgttgggcttccaggtgcccggcagcgtcaacgcgatcaccctcttccccggtggtttgacgttcccggcgacctcgctgctgaacctggacgtgaccgccggcgccggcggcgtggacatcccggccatcacctggcccgagatcgcggcgagcgccgacggctcggtgtatgtcctcgccagcagcatcccgctgatcaacatcccgcccaccccgggcattgggaacagcaccatcaccccgtcgtcgggcttcttcaacgccggcgcgggcgggggatcgggcttcggcaacttcggcgcgggcacctcgggctggtggaaccaggcgcacaccgcgctggcgggggcgggctcgggttttgccaacgttggcacgctgcattccggtgtgctcaacctgggctcgggtgtctcggggatctacaacaccagcacgctgggggtggggaccccggcgctggtctcaggcctgggcaacgtcggccaccaactgtcggggctgctttccggcgggtccgcggtgaacccggtgaccgttctgaatatcgggttggccaacgtcggcagccacaacgccggtttcggcaatgtcggggaggtcaacctgggcgcggccaacctcggcgcgcacaacctgggcttcggaaatatcggcgccggcaacctggggttcggcaatattggccacggcaatgtcggagtcggcaactcgggtctgaccgcgggcgtgccgggcctgggcaatgtggggttgggcaatgccggcggcaacaactgggggttggccaacgtgggcgtgggcaatatcgggttggccaacaccggcaccggcaacattgggatcgggctgaccggcgactaccagaccggcatcggcggcctaaattccggtgccggcaacctggggttgttcaactccggcgccggcaacgtcgggttcttcaacaccgggaccggcaacttcgggttgttcaactccggcagcttcaacaccggcgtcggcaatagcggaacgggcagcactgggctcttcaatgccggcagtttcaacaccggtgtggccaacgccggcagctacaacacgggcagcttcaatgtcggtgacaccaacaccgggggcttcaacccgggcagcatcaacaccggctggctcaacgccggcaacgccaacaccggggtggccaacgcgggcaatgtcaacaccggcgccttcgtcaccggcaacttcagcaacggcatcctgtggcgcggcgactaccagggcctggccggcttcgccgtgggctacaccctcccgctgttccccgcggtgggcgccgacgtcagcggcgggatcggcccgattaccgtgctgccgcccatccacatcccgcccattccggtcggcttcgccgcggtcggtggcatcggcccgatcgccatcccggacatctctgttccatccattcacttgggcctcgaccccgccgtccatgtcggctccatcaccgtcaaccccattaccgtcaggaccccgcccgtgctcgtcagttactcccaaggagccgtcaccagcacgtccggaccaacctcagagatttgggtcaagcccagcttcttccccggaatccggatcgcgccctctagcggcgggggtgcaacgtccacgcaaggggcatactttgtggggcccatctccatcccctccggcacggtgaccttcccgggattcaccatccccctcgacccgatcgacatcggcctgccggtgtcgctgaccatcccggggttcaccatcccgggcggcaccctgatccccaccctcccgctgggcctcgcgttgtccaatggcatcccgcccgtcgacatcccggccatcgttctcgaccggatcttgctggacctgcacgccgacaccactatcggcccgatcaacgtcccgatcgccgggttcggcggggcgccgggtttcgggaactcgaccacgctgccgtcgtcgggcttcttcaacaccggagctggcggcggttcgggctttagcaacaccggcgcgggcatgtcgggattgctcaacgcgatgtcggatccgctgctcgggtcggcgtcgggcttcgccaacttcggcacccagctctccggcatcctcaaccgcggcgccggcatctcgggcgtgtacaacaccggcgcgctgggtgttgtcaccgcggccgtcgtctcgggtttcggcaacgtcggccagcaactgtcgggcttgctcttcaccggcgtcgggccctaa

SEQ ID NO: 526 - DNA, 9474 bp, Mycobacterium tuberculosis H37Rv
ttgaattttccagttctgccaccggaaatcaactccgtgctgatgtattcgggtgcggggtcgagcccgttgctggcggcggccgcggcgtgggatgggctggctgaggagttggggtcggcggcggtgtcgtttgggcaggtgacgtcgggcctgacggcgggggtgtggcagggtgcggcggcggcggcgatggcggccgcggcggccccgtatgcggggtggttgggttcggtggcggcgcaggccgtggcggtggccgggcaggcgcgggccgcggtggcggcgtttgaggcggcgttggcggcgacggtggatccggcggcggtggcggtcaaccggatggcgatgcgggcgttggcgatgtcgaacctgctggggcagaacgccgcagcgatcgcggccgtcgaggccgagtacgagttgatgtgggccgccgatgtggcggcgatggccggctaccattccggcgcgtcggctgctgccgcggcgttgccggcgttcagcccaccggcgcaggcgttggggggtggtgtcggcgcgttcctcaatgctctatttgccggacccgcgaagatgttgaggcttaacgcgggcttgggcaatgtcggtaattacaacgtcgggttgggcaatgtcgggatattcaacctgggcgcagccaatgtcggtgcgcagaatttgggtgctgccaacgccggtagcgggaatttcggtttcggcaatatcggcaacgccaacttcgggttcggcaactcgggtcttgggttgccgccgggcatgggcaatattgggttgggcaatgcgggcagcagcaactacggcctcgcaaacctgggtgtgggcaacatcggttttgccaacacgggtagcaacaacatcgggatcgggttgaccggggacaacctgactggcattgggggcctgaattcaggaaccggtaatctggggttgttcaactccggcaccggcaacattgggttcttcaattcggggaccggcaacttcggggtattcaactcgggcagctacaacaccggtgtcggtaatgcggggacggccagtaccgggttgttcaacgttggtgggttcaacacgggtgtggccaacgtgggtagctataacacgggcagcttcaacgcgggcaacaccaatacgggtggcttcaacccgggcaacgtcaacaccggctggctgaacaccggcaacaccaacaccggcatcgccaactcgggcaatgtcaacaccggcgcgttcatctcgggcaacttcagcaacggtgtgctgtggcggggtgactacgagggcctgtgggggctctccggtggatcgaccattccggcgatccccattggtctcgagctcaacggcggcgtcggccccatcaccgtgttgccgatccagattttgcccaccatcccgctcaacattcaccaaaccttcagcctcggcccgctggtcgttccggacatcgtgatccccgcttttggtggcggtacggccatacctatcagcgtcggccccatcaccatctcgcccatcaccctgttcccggctcagaacttcaacacgactttccccgtcggccccttctttggcttgggggtcgtcaacatttcaggaatcgaaatcaaagatcttgccggcaacgtcaccctccaattaggtaaccttaatatcgacaccagaattaaccagtcattcccggtgaccgtcaactggagtaccccggcagtaacgatcttcccgaatggcatcagtattcccaacaatccactggcgctgctggccagcgcgtcgatcggcacgctgggattcacgatcccgggcttcaccattcccgctgcgccgctgccgctgacgatcgacatagacggccagattgacggcttcagcaccccgccgatcacgatcgaccgcatcccgctgaacctcggcgccagcgtcactgtcggccctatcctgatcaacggcgttaatatcccggcgaccccgggctttggcaacacgaccaccgctccgtcgtcgggtttcttcaactccggcgacggtggggtgtcgggcttcgggaatttcggtgcgggcagctcgggttggtggaaccaggcgcagaccgaggtggctggggcgggttcgggtttcgccaatttcggttcgctgggatcgggtgtgctgaacttcggctcgggtgtgtcggggctgtacaacaccggcgggttgccgccggggaccccggcggtggtctcgggcatcggcaatgttggtgagcagctgtcggggttgtcctcggcggggacggcactcaaccagagcctcatcatcaatctcgggttggccgatgtgggcagcgtaaacgtcggtttcggcaacgtcggggacttcaacctgggtgcggccaatatcggcgacttgaacgtgggtttgggcaatgtcggcggcggcaacgtcgggttcggcaatatcggcgatgccaacttcgggttgggcaatgcgggtctggcggcgggcctggccggggtgggcaacatcgggttgggcaatgccggcagcggcaacgtcggcttcggcaacatgggtgtgggcaacatcgggttcggtaacaccggcaccaacaacctcgggattgggctgaccggggacaaccagactgggatcggcggcttgaactccggtgccggcaacatcgggttgttcaactccggcaccggcaacgtcgggttgttcaactccgggaccgggaacttcgggttgttcaactcgggcagcttcaacaccggcatcggcaatggcggaacgggcagtactgggcttttcaatgccggtaatttcaataccggtgtggccaaccctgggtcgtacaacacgggcagcttcaatgtgggtgacaccaacaccggtggtttcaacccgggcagcatcaacaccggctggttcaacaccggcaacgccaacaccggcgtcgccaattcgggcaatgtcgacaccggcgccctcatgtcgggcaacttcagcaacggcatcttgtggcgaggcaacttcgagggcctgttcggcctgaacgtcggcatcacgattcccgaattcccgatccactggacttcaaccggcggcatcggccccattatcatcccggacaccacgatccttccccccatccacctgggcctcacgggacaagcgaactacggcttcgccgtgccggacatccccattccggcaatccacatcgacttcgacggtgccgccgacgccggcttcaccgccccggccaccaccctgctttctgcgctgggcattaccggacaattcaggttcggcccgatcaccgtctcaaacgtccagctcaatccgttcaacgttaacctcaagcttcagttcctccacgacgcgttcccaaatgaatttcccgatcccacaatctcggttcagatacaggtcgccataccccttacttcggcaacgctgggcggattggccctgccgctgcagcagaccatcgacgccatcgaattgccggcaatctcgttcagccaatccatacccatcgacattccgccgatcgacatcccggcctccactatcaacggaatttcgatgtcggaggtcgtgccgatcgatgtgtccgtcgacattccggcggtcaccatcaccggcaccaggatcgacccgattccgctgaacttcgacgttctcagcagcgccggacccatcaacatctcgatcatcgacattccggcgctgccgggctttggcaactcgaccgagctgccgtcgtcgggcttcttcaacaccggcggcggtggcggctcgggcatcgccaacttcggcgcgggggtgtccggcttgctgaaccaggcctcgagtccgatggtggggacgctctccggcctgggcaatgccggcagcctggcatccggtgtgctgaactccggcgtcgacatctcgggcatgttcaacgtgagcacgctgggctccgcgccggcggtgatctcgggtttcggcaacctgggcaaccacgtgtcgggggtgtccatcgatggcctgctggcgatgctgaccagcggcgggtcgggcggctccgggcagccgagcatcatcgacgcggcgatcgccgagctgcggcacctgaatccgctgaacatcgtcaacctgggcaacgtcggcagctacaacctcggcttcgccaacgtcggcgacgtcaacctgggcgcgggcaacctcggcaacctcaacctcggcggtggcaacctcggcgggcagaacctggggttgggcaacctcggggacggcaacgtcgggttcggcaacctcggccacggcaatgtcgggttcggcaactcgggcctgggggcgctgccggggatcggcaacatcgggttgggcaacgccggcagcaacaacgtcggcttcggcaacatgggcctgggcaacatcgggttcggcaataccggcaccaacaacctcgggatcgggctgaccggcgacaaccagaccgggttcggcggcctgaactccggtgccggcaacctggggttgttcaactccggcaccggcaacatcgggttcttcaacaccgggaccggaaactgggggttgttcaactcgggcagctacaacaccggcatcggtaacagcggaacgggcagtaccgggcttttcaatgccgggagtttcaacacgggtctggccaatgccggtagttacaacaccggcagcctcaacgcgggcaacaccaacaccggcggcttcaaccctggcaatgtcaacaccggctggttcaacgccggccacaccaacaccggcggcttcaacacgggcaatgtcaacaccggcgcgttcaactccggcagcttcaacaacggcgcgctgtggaccggtgatcaccacgggctggtcggcttctcctacagcatcgaaatcaccggcagcaccctggtggacatcaacgaaaccctcaacctcggtcccgtccacatcgatcagatcgatattcccggcatgtcgctgttcgacatccacgaactcgtcaacatcgggcccttcaggatcgagcccatcgatgtccccgcagtggtgctggacatccacgaaacgatggtcatcccgcccatcgtcttcctgccgagcatgacgatcggcggtcagacctacacgattccgctcgacacgcccccggcccccgccccgccgcccttcagacttccgttgctgttcgtgaatgcgctcggcgacaactggatcgttggggcgtccaactcaaccggaatgagtggtggctttgtcaccgcacccactcagggcatcctgatccataccggtcccagcagcgcaaccaccggtagcctcgcactaaccctcccaaccgtcaccatcccaacgatcacgacatcgcctatcccgctcaagatcgatgtgtcgggcggtcttccggccttcacgctgttccccggtggcctcaacatcccgcaaaatgcgatcccgttgaccatcgatgcgtccggcgtgctggatccgatcacgatattcccgggtggtttcacgatcgatccgctgccactgagcctggccctcaacatcagcgtgccggacagcagcgttccgatcatcatcgttccgccgacgcccggcttcgggaacgcgaccgccaccccgtcgtcgggtttcttcaactccggcgcgggcggggtgtcgggtttcggcaacttcggggccggcagctcaggctggtggaaccaggcgcatgccgcgttggcgggcgcgggctcgggcgttctcaacgttggcacgctgaactcgggtgtgctgaacgtcggctcggggatatcggggctgtacaacaccgctatcgtgggtttggggacgccggcgctggtgtcgggtgccggcaacgtgggccagcagctgtcgggggtgttggcggccgggacggcgttgacccaaagccccatcatcaacctcgggttggccgatgtcggcaactacaacctcgggttgggcaacgttggggacttcaacctgggcgcggccaacctcggcgacctcaacctagggttgggcaatatcgggaacgccaacgtcggcttcggcaatatcggccacggcaacgtcgggtttggcaattcgggcctgggggcggcgctcggcatcggcaatatcgggttgggcaatgcgggcagcaccaacgttggcctggccaacatgggtgtgggcaacatcgggttcgccaacaccggcaccaacaacctcgggattgggctgaccggcgacaaccagaccggcatcggcggcttgaactccggtgccggcaacattggcctgttcaactccggcaccggcaacatcgggttcttcaactccgggaccggaaactgggggttgttcaactcgggcagcttcaacaccggcatcggtaatagcggaacgggcagtactgggcttttcaatgccggtggtttcactacgggtctggccaacgccgggtcgtacaacacgggcagcttcaatgtcggtgacaccaacaccggtggcttcaacccgggcagcatcaacaccggctggttcaacaccggtaacgccaacaccggcatcgcgaactcgggcaatgtcgacaccggcgccctcatgtcgggcaacttcagcaacggcatcctgtggcggggcaactacgaaggcctattcagctattcctacagcctcgacgttccccggatcaccatcctggacgcgcatttcaccggggccttcggcccggtggtcgtcccgcccatcccggttctggcgatcaacgcgcacctgaccggcaacgcggcgatgggcgccttcaccatcccgcaaatcgatattcccgccctcaatccgaacgtcaccggaagcgtcggcttcggccccatcgcggtcccctcggtcaccattcccgccctgaccgccgcacgagcggtcctcgatatggccgcgtcggtcggggcgaccagcgaaatagagccgtttatcgtctggacgtcatccggtgcgatcggcccaacgtggtactcggtcggcagaatctacaacgccggtgacctgttcgtcggcggcaatatcatctcgggaatcccgacgctcagcacgaccggcccggtgcatgccgtcttcaatgcggcatctcaggcgttcaacaccccggcgctcaatattcaccagatcccgttgggtttccaggtgccgggcagcatcgacgcgatcaccctgttccccggtggtctgacgttcccggcgaactcgctgctgaacctggatgtgttcgtcggcacccccggcgccaccattccggcgatcacgttcccggagatcccggcgaacgccgacggcgaactctacgtcatcgccggcgacatcccgctgatcaacatcccgcccaccccgggcattgggaacaccaccaccgttccgtcgtcgggcttcttcaacaccggggcgggcgggggctcgggtttcggcaacttcggcgcgaacatgtcggggtggtggaaccaggcgcacaccgctttggcaggcgcgggttcgggtattgccaacgtcggcacactgcactccggcgtgctcaacctcggttcggggctgtcggggatctacaacaccagcacgctgccgcttgggacgccggcgttggtgtcgggcctgggcaacgtcggtgatcacctgtcgggcttgttggcctccaacgtggggcaaaaccccatcaccatcgtcaacatcgggttggctaacgtcggcaacggcaacgtcggcctcggcaacatcggcaacctcaacctgggtgcggccaacattggcgacgtgaacctgggattcggcaacattggcgacgtgaacctgggcttcggcaacatcggcggcggcaacgtcgggttcggcaatatcggcgatgccaacttcgggttcgggaattcgggtctggcggcgggcctggccggcatgggcaatatcgggctgggcaacgccggcagcggcaacgtcggctgggccaacatgggcctgggcaacatcgggtttggcaacaccggcaccaacaacctcgggatcgggctcaccggcgacaaccagtccggcatcggcggcttgaactccggcactggcaacattggcctgttcaactccggcacaggcaatatcggcttcttcaactccgggactgccaacttcgggttgttcaactccggcagctacaacaccggtatcggcaactccggggtggccagcaccgggttggtcaacgccggcggcttcaacaccggtgtggcaaacgccgggtcgtacaacacgggcagcttcaatgctggtgacaccaacaccggtggcttcaacccaggcagcaccaacaccggctggttcaacaccggtaacgccaacaccggcgtcgccaacgcgggcaatgtcaacaccggcgccctcatcacgggcaactttagcaacggcatcttatggcggggcaattacgagggcttggccggcttctccttcgggtaccccattccgctgttccccgcggtgggcgccgacgtcaccggcgacatcggccccgccaccatcattccgcccatccacatcccgtccatcccgttgggcttcgccgcgatcggccacatcgggccgatcagcatcccgaacatcgccatcccctcgatccacctgggcatcgatcccaccttcgacgtcggccctatcaccgtggaccccatcaccctcaccatccctggcctaagtttggatgctgccgtctcggagatcaggatgacgtccggaagcagctccggattcaaggtcagacccagcttttcattcttcgcggtcggacccgacggcatgcccgggggcgaggtctccatacttcaaccattcaccgtggcacccatcaacttgaacccgacgacactgcacttccccggattcaccattcccaccggacccatccacatcggcctgccgctgtcgctgaccattccgggcttcaccatcccgggcggcaccctgattccccaactcccgctgggcctcggtttgtccggcggcaccccaccctttgatctcccgacggtcgttatcgaccggatcccggtggagttacacgccagcaccaccatcggccccgtcagcctcccgattttcgggttcggcggagcaccgggctttggcaacgacaccaccgcgccgtcgtcgggcttcttcaacaccggcggtggtggcgggtccggcttctccaactccgggtcgggcatgtcgggggtgctcaacgcgatctcggatccgctgctcgggtcggcgtcgggcttcgccaatttcggcacccagctctccggcatcctcaaccgtggcgcgggcatctcgggcgtgtacaacacgggcacgcttggcctggtcacatcggccttcgtctcgggctttatgaacgtcggccagcagctgtcgggcctgctgttcgcgggcaccgggccgtaa

SEQ ID NO: 527 - DNA, 7572 bp, Mycobacterium tuberculosis H37Rv
atgagttttgtcgtaatgccgccagagatcaactccctgctgatatataccggggcgggtccgggccccctgttggcggcggccgcggcctgggatgagctggccgccgagctgggctcggcggcggcggctttcgggtcggtgacctcggggctggtcggtggtatctggcaggggccgtcctcggtcgcgatggcggcggcggccgccccgtatgcggggtggttgagcgcggcggcggcctccgccgagtcggcggccgggcaggcccgggcggtggtgggtgtgttcgaggcggcgttggccgagacggtggaccccttcgtcatcgcggccaatcggtcgaggttagtgtcgctggcgttatcgaatctgttcggccagaacacgccggcgatcgcggccgcggagttcgactacgagctgatgtgggcccaggacgtggccgcgatgctggggtaccacaccggcgcctcggcggcggccgaggcgttggcgccgtttggctcgccgctggcaagcctggcggccgccgccgagccggccaagtcgctcgccgtcaatctgggtttggccaacgttggcctcttcaacgcgggaagcggcaacgtcggcagctacaacgtgggggccggcaacgtcgggagctacaacgtgggcggcggcaatatcggtggcaacaatgtcgggttgggcaatgtcgggtggggcaactttgggctcgggaattcggggttaacgccgggtctgatgggtctgggtaatatcgggtttggtaatgccggcagctacaatttcggtttggcgaatatgggtgtgggcaatattgggttcgctaacaccggcagtgggaatttcggtattgggttgaccggtgataatctgaccgggttcggtggtttcaataccggtagcgggaatgtggggttgtttaattcggggaccggtaatgtggggttctttaactccggcaccgggaactggggggtgttcaattcggggagctataacaccgggatcggtaattcggggattgccagcacggggttgttcaacgcgggtgggttcaatacgggtgtggtcaatgcgggtagctacaacaccggcagtttcaacgcgggggaggccaatacgggcggtttcaacccgggcagtgtcaacacgggttggttgaacaccggtgacatcaacaccggggtggccaactccggcgacgtcaacaccggtgccttcatctccggtaactacagcaacggcgtcttgtggcggggcgactaccagggcctgctcggcttctcctcgggagcgaacgttcttcctgtcattcccctcagcctggacataaacggtggtgtcggcgccatcactatcgagcccatccacatacttcccgacatcccgatcaacatcaacgaaaccctctacctcggacccttggtcgtcccgcccatcaacgtcccggcaatctcgctcggcgtcggcatacccaatatttcgatcggccccatcaaaatcaatcccatcaccctgtggccggcacaaaacttcaaccaaaccatcacgctggcctggcccgtctcgtccataacaattccccaaatccaacaggtcgccctcagcccttcccccattcccacaaccttgatcggcccaatacatatcaataccgggttttccatcccagtaaccttcagttattccaccccagccctcacccttttcccggttggcctcagcattcccaccggggggccgctcaccctgactcttggcgtaacggcaggcaccgaggccttcaccattccgggattctcgattcccgagcaaccacttccgctggcgatcaacgtgattggccacatcaacgccctgagcaccccggcaatcaccatcgacaacatccccctgaacctgcacgccatcggcggcgtcgggcccgtcgacatcgtgggcggcaacgttccggcgtcgccggggttcgggaattcgaccaccgccccgtcctcgggcttctttaacaccggcgccggcggggtgtcgggattcgggaacgtcggcgcgcacacctcgggctggtttaaccagtccacccaggccatgcaggtgttgccgggaacggtttcgggctatttcaactccggcacgttgatgtcgggtatcggcaatgtaggtactcagttgtcggggatgttgtcgggcggcgcgctgggcggcaacaacttcggattgggcaatatcgggttcgacaacgtcgggttcggcaatgccggcagcagcaatttcggcctggcgaacatgggcatcggcaacatcgggttggccaataccggcaacgggaatatcggtatcgggctcagcggggacaatctgactgggttcggtggtttcaattcgggcagcgagaatgtgggattgttcaattcgggtaccggcaatgtcgggttcttcaactccggcaccgggaatttgggcgtattcaattcgggaagccacaacaccggtttcttcttaacgggcaacaacatcaacgtcctggcccccttcacccccggcacccttttcaccatttccgaaatccccattgacctgcaggtgattggcgggatcggtcccatccacgtccagcccatcgatattccggcattcgacatacaaatcaccgggggattcatcgggatccgcgaattcactctcccggagatcaccattcccgcgatcccgatccacgtgaccggaaccgtcggcctcgagggttttcacgtgaatcccgcgtttgttcttttcgggcaaaccgccatggcagaaatcaccgcggacccggtcgtcttgccggacccgttcatcacgatcgaccactacggcccgccgctaggcccacccggcgcgaaattcccctccgggtcgttctacctcagcatcagcgacctgcagatcaatggacccatcatcggcagctacggcggcccgggcacgatccccggcccgttcggcgcgactttcaatctgtccacatcgtccttggccttgttcccggccggcctcaccgttcccgaccaaacaccggtgaccgtcaacctgaccggcggcctggacagcatcacgctattcccgggcggcctggcgttcccggaaaaccccgtggtcagcctcaccaacttctccgtcggcaccggtggattcaccgtgttcccgcagggtttcacggttgaccgcatcccggtggacctgcacaccaccctttctattggccctttcccgttccggtgggactacatcccgccaaccccggccaacggccccattccggcggtcccaggcggctttggcctcaccagcgggctgtttccatttcacttcaccctcaacggcggcatcggccccatcagcatcccgaccaccaccgttgtggatgcgctaaatcccctcctgaccgtcacgggaaacctcgaggtcggcccctttaccgtcccggacatccccatccccgccatcaattttggcctcgacggaaacgtcaatgtgagttttaacgccccggccactaccctgctgtccggcctgggcatcacgggaagcatcgatatctccggaatccaaatcacgaatatacagacccagcccgcccagctgttcatgtcggtcggtcagactcttttcttgtttgacttcagagacggcatcgaactgaatccgattgtaattccgggaagttctattcccatcaccatggcgggactcagtatcccgttgcccactgtcagtgaatccataccgctcaacttctctttcggttccccggcatccaccgtaaagtcaatgattctgcacgaaatcctgcctatcgacgtgtccatcaacctcgaggacgccgtcttcatcccggccaccgtgctgcccgcaattccgctgaacgtggacgtcacaatcccggtgggccccatcaacatcccgatcatcaccgagccgggctcagggaactccaccaccaccacgtcggatcccttcagcggtttggctgtcccgggcctgggtgtgggactgttgggcctgttcgacgggagcatcgccaacaacctgatctcgggcttcaattccgcggtcgggatcgtcggcccgaacgtggggttgagcaacctcggtggcggcaatgtcgggttgggcaatgtcggggactttaacctgggtgcgggcaacgtcggtgggttcaatgtgggtggcggcaatatcggcggcaacaatgtcgggttgggcaatgtcgggtttggcaatgtcgggttggcgaattcggggttaacgccgggtctgatgggtttgggtaatatcgggtttggtaatgccggcagctacaatttcggtttggcgaatatgggtgtgggcaatattgggttcgctaacaccggcagtgggaatttcggtattgggttgaccggtgataatctgaccgggttcggtggtttcaataccggcagcgggaatgtggggttgtttaattcggggaccggtaatgtggggttctttaactctggcaccgggaactggggggtgttcaattcggggagttataataccgggatcggtaattcggggattgccagcacggggttgttcaacgcgggtgggttcaacacgggtgtggtcaatgcgggtagctacaacaccggcagtttcaacgcggggcaggccaatacgggcggtttcaacccgggcagtgtcaacacgggttggttgaacaccggtgacatcaacaccggggtggccaactccggcgacgtcaacaccggcgccttcatctccggtaactacagcaacggcgccttctggcggggcgactaccagggcctgctcggcttctcctaccgccccgccgtgcttccccaaacgccgttcctggacctcaccctcaccggcggactgggctccgtcgttatccccgccatcgacattcccgcgatccgccccgagttcagcgccaacgtcgccatcgacagcttcactgtgccgagcatcccgattccccagatcgacctggccgccaccacggtcagcgtcggcctcggccccatcaccgtcccgcacctcgatattccacgggtgcccgtcacgctgaattacttgtttggctcacaacccggcgggcccctgaaaatcggtccgattacgggactcttcaacacccccatcggccttacccccctggcgttaagccagatagtcatcggtgctagctcgtcgcaagggaccatcacggctttcctggccaacctgccgttcagcacccccgtcgtcaccattgacgagatcccgctgctggccagcattaccggccacagcgagcccgtcgacatcttcccgggcggcctcacgatccccgcgatgaacccgctgagcatcaacctgtccggtggcaccggcgccgtcaccattccggcaatcaccatcggcgaaatcccctttgacctcgtggcccacagcacgctcggccccgttcacatcctcatcgaccttcccgccgtgccggggttcgggaatacgaccggtgctccgtcgtcgggtttcttcaactccggtgcgggtggggtgtcggggtttgggaatgtcggcgcgatggtgtcgggtggctggaatcaggctccgtcggcgttgctgggtgggggttcgggtgttttcaacgccggcacgctgcattcgggtgtgctgaatttcggctctggcatgtcggggctgttcaacaccagcgtgttggggttgggtgcgccggcgttggtgtcgggtttgggtagtgtcggtcagcagttgtcgggattgttggcgagcgggacggcgctgcatcagggtctggtcctcaatttcgggttggccgatgtggggttgggcaatgtcgggttgggcaatgtcggggactttaacctgggtgcgggcaacgtcggtgggttcaatgtgggtggcggcaatatcggcggcaacaatgtcgggttgggcaatgtcgggtggggcaactttgggctcgggaattcggggttaacgccgggtctgatgggtttgggtaatatcgggtttggtaatgccggcagctacaatttcggtttggcgaatatgggtgtgggcaatattgggttcgctaacaccggcagtgggaatttcggtattgggttgaccggtgataatctgaccgggttcggtggtttcaataccggcagcgggaatgtggggttgtttaattcggggaccggtaatgtggggttctttaactctggcaccgggaactggggggtgttcaattcggggagttataacaccgggatcggtaattcggggattgccagcacggggttgttcaacgcgggtgggttcaacacgggtgtggtcaatgcgggtagctacaacaccggcagtttcaacgcggggcaggccaatacgggcggtttcaacccgggcagtgtcaacacgggttggttgaacaccggtgacatcaacaccggggtggccaactccggcgacgtcaacaccggcgccttcatctccggcaactacagcaacggcgccttctggcggggcgactaccagggcctgctcggcttctcctacaccagcaccatcattcccgaattcactgtcgcgaacatccacgcgtccggcggcgccggacccatcatcgttccgtcgatccaatttccggcaattcccttggacctcagcgcaaccggccacatcggcggcttcaccatcccgccggtgtccatttccccgatcacggttcgcatcgacccagtcttcgacctcggccccatcaccgtccaggacatcacgattcccgccctgggactcgaccccgcaaccggtgtcaccgtgggcccgatattcagctcaggctccatcatcgatccattcagccttacgctgctggggttcatcaacgttaatgtccccgccatccaaacggcgcccagcgagattctgccattcaccgtgctgctgagttcgcttggcgtgacccatctaacaccggaaatcaccatcccgggattccacatacccgtcgatccaatccatgtcgagctgcccctgtccgtcaccatcggacccttcgtgagcccggaaatcaccattccccaactcccgctgggcctcgcgttgtccggcgccacccccgccttcgccttccctctggagatcaccatcgaccgaatcccagtggttctcgacgtcaacgcgctgctcggccccatcaacgccgggttggtcatcccgcccgtcccgggattcggcaacaccaccgcggtcccgtcgtcggggttcttcaacatcggcggtggcggcgggttgtcgggcttccacaacctcggcgcgggcatgtcgggcgtgctcaacgcgatctcggatccgctgctcggatcggcgtcgggcttcgccaacttcggcacccaactctccggcatcctcaaccgcggcgcggacatctcgggtgtgtacaacaccggcgcgctgggcctgatcacctcggccctggtctccggcttcggcaacgtcggccagcaactggcgggcctgatttacaccggcaccgggccctaa

SEQ ID NO: 528 - DNA, 2337 bp, Mycobacterium tuberculosis H37Rv
atgtcatttgtgattgcggtgccggaagcattgacgatggcggcttcggatctggccaacattgggtcgacgatcaacgcggcgaatgcggcggcggcattgccgaccacgggggtggtggcggctgccgcggatgaggtttcggcggcagttgcggccttgttcgggtcgtacgcgcagagctatcaggcttttggtgcgcagctgtcggcgtttcacgcccagttcgtgcagtcccttacgaacggcgcgcgctcatacgtagttgccgaggccaccagtgctgcgccgttgcaggatttgttgggcgtggtaaatgcccccgcccaggcgttgttggggcgcccgttgatcggcaatggcgctaacggggccgacgggacgggggctcccggtgggccgggcgggctgttgcttggcaacggcgggaatggcggatcgggtgcgccgggtcagccaggtggtgctggcggggatgcggggttgatcggtaacggcgggactggcggtaaaggtggggacgggctggtcgggtccggtgctgccgggggtgtcggtggtcgcggtggatggttgctgggtaatggcgggaccggtggggctggtggggctgcaggggccactttggtcggcggtactggcggtgtcggtggggcgacggggttgatcggcagcgggggcttcggcggtgctggcggggccgcggcgggggtgggcaccaccggcggcgtgggcgggagcggtggcgttggcggcgtgttcggcaatggtggattcggcggggccggtggccttggcgccgccggcggcgtcggaggggcggccagctacttcgggaccgggggcggtggcggcgttggtggggacggtgcgcccggtggtgacggcggtgcgggtccgctattgatcggcaatggcggtgttgggggtctgggtggggccggggcggccggtggtaatggcggtgccggcgggatgttgttgggcgatggcggtgccggcggacagggtgggccggccgtggcgggtgtcctgggcgggatgcccggcgcgggcggcaacggcggtaatgccaactggttcgggtccggtggtgccggcgggcagggtggcaccggtctggccgggacaaacggggtcaaccccggctcgattgcgaaccccaacaccggtgcgaacggtaccgacaacagcggcaacgggaatcaaactggcgggaacgggggtcccggccccgccggtggcgtcggcgaggctggcggcgtcggcgggcagggcgggctgggggagtcgctcgacggcaacgacggcaccggcggtaagggtggagccgggggtactgccggtaccgatggcggtgccggcggcgctggcggcgctggcggcataggtgagaccgacggcagcgccggcggcgtggctaccgggggtgaggggggtgacggtgccaccggaggggtcgacggtggcgtgggtggtgctggcggcaagggggggcaggggcacaacacgggtgtaggtgacgctttcggcggtgacggcggaatcggcggtgacggtaacggggcactaggcgcggcgggcggtaacggcggcaccggtggtgccggtggaaacggtggacgtggcgggatgttaatcggcaacggcggcgccggtggggccggcgggacgggcggcaccggtggtggtggcgccgccggcttcgcgggcggtgtcggcggcgcgggcggagagggtctcaccgacggtgcgggtaccgcggaaggcggcaccggcggtctggggggcctcggcggtgtcggcggtaccggcggtatgggtggcagcggcggtgtcggcggcaacggcggggcggctgggtcgctcatcgggcttggtggtggcgggggtgccggcggtgtcggcggcaccggtggcatcggcggcatcggtggtgccggcggcaacggtggcgccggcggcgcgggtaccaccaccggcgggggagcgacaattggcggtggcggcggtacaggcggcgtggggggcgctggtggcactggcggtaccggcggcgccggcgggaccaccggcggcagcggcggagccggcgggctgatcgggtgggcaggagctgccggcggcaccggcgcaggcggcacgggtgggcaaggtggcctcggcggccagggcggcaacggcggcaacggcgggaccggcgcgaccggcggtcagggcggcgatttcgcgctgggcggcaacgggggcgccggcggcgcgggtgggtcaccgggtggcagctccggcatccagggcaatatgggcccgcccggcacccagggcgccgacggatag

SEQ ID NO: 529 - DNA, 3240 bp, Mycobacterium tuberculosis H37Rv
ccccaaggcgccgacggcaacgccggcaacggcggtgacggcggggtcggcggcaacggcggaaacggcgcagacaacaccaccaccgccgccgccggcaccacaggcggggccggcggggccggcggggccggcggaaccggcggaaccggcggagccgccggcaccggcaccggcggccaacaaggcaacggcggcaacggcggcaacggcggcaccggcggcaaaggcggcaccggcggcgacggtgcactcgcaggcagcagcggtggtgccggcggtaaaggcggcaacggcggcgacgccggcaaggccggtaccggctccgctcctggcacggcggggaccggcggcgatgggggtaagggcggcaacggcggcattggcgctgccggcacaaccggccccgtaggcaccggcgcgtccggcggcaccggtggtagtggtggcgccggcggaaccggcggtgacggcggcgccgccaacggcggcaccgccggggctggcggggcgggcggcaatggcggcaaaggcggcgacggtggagcaggcgtcaccagcagcaccgccggcaacagcggcggcgcgggcggcagcggcggaaagggcggagacgcgggcgcgggcggcgccggtgccactccgggcgccaacggtatcgctggcaatggcggcgacggcggagatggcgcggctggtgccgtcggcatctccggcgcaaccggcgctggcgacggcgggcatggcggaaccggcgcggccggcggcaacggtggaaccggcggtgctggcggtagcggcatcgacggcgtcggcggcgggaccggaggtaccggcggcaacggcggcaacggcgccatcggcggcgctggcggagacgccggtggtagcggaaatagcggcggaaacggtgggattggcggaaagggcggaaacgccggtgccggtggtgccgcgggcagcaacggcggtaccgtcggcgccaacggtaccggcggcgacggcggcaacggcggcgctgccggggccgccacggctggcagcaacggtggggccggcaccggctcggccggcggcaacggcggcaccggcggcagaggcggcagtggtggcgccggcggcgacggtatcggtggcgtcggcggcggcaagggcggcaacggcgcggacggcgaagtcggcggtgcgggcggcgccggcggcagcgggcccaacaccagtcccggcggcaacggcgggcaaggaggtcaaggcggcagcggtggtgccggtggggcggccggggctggcggcgccggtggcggcgctaacggcaccgctggcaacggcggccaaggcggtgccggcggcaccggcggcgccggcgcagcctcctcagctaccaacggcggcagcggcggcgccggcggcaccggaggcgacggcggcagcggcggcgccggcggcaccggaggcgccggcggcaccggcggggcggccggcgacggcggacaaggtggccagggcggcgccggcggcggtgccggtggtcaaggtggtgccggcggtgccggcgggaccggcggcaacggcggcaatatcaccggcggcaccgcgggcaccgcgggggccgccggtaacggcggcgccgccggaaagggtggcgccggcggccaaggcggcaccggtggcgggaccgggggtcagggtggcgccggcggcgacggcggtgccggcggcaccggcggcgaccgcaccgtcggcggtggcacggtccccgccggctccggtggacaaggcggtaacgctggcggtggtggggccggcgggcagggtggagccgacggcggcagcggcggcgacggcggcgacgccggcacaggtggcaatggcggtaacggcggcaaccgtaattccggcaatggcaccggcggcgctggcggcaacggtggtggtggtgctaacggtggcgccggcggcgctgggggcagcggcggcggcaccggcggcaacggcggcgctggcggcgacgccggcgacgccggcaacggcggcaacggcaacggcaccggcaacggcggcaacggcggcaacggcggcatcgccggcatgggcggcaacggcggtgccgggacgggcagcggcaacggcggcaacggcggcagcggcggcaacggcggcaacgccggcatgggcggcaacagcggcaccggcagcggcgacggcggtgccggcgggaacggcggcgcggcgggcacgggcggcaccggcggcgacggcggcctcaccggtactggcggcaccggcggcagcggtggcaccggcggtgacggcggtaacggcggcaacggagcagataacaccgcaaacatgactgcgcaggcgggcggtgacggtggcaacggcggcgacggtggcttcggcggcggggccggggccggcggcggtggcttgaccgctggcgccaacggcaccggcgggcaaggcggcgccggcggcgatggcggcaacggggccatcggcggccacggcccactcactgacgaccccggcggcaacgggggcaccggcggcaacggcggcaccggcggcaccggcggcgcgggcatcggcagccttggcggcggcactggcggcgatggcggcaacggcggcaacggcggtaccggcggcgagggcggcgaggtcggcggcgccggcggcaccggcggtgcggccggcaatggcggcgatggcggcaccggcggcaccggcggcggggacgggggcgccggcggcaccggcggcaccggcggcaccggcggcctcggcgacccccgggtcggcggatccggcggcgacggcggcaccggcggcagcggcggtgcggccggcaatggcggcaacggcggcaacgccggcgcgggaggcaatggcaacggcggcaccggtggggccggcggtatcggcggcaccggcggcaatggcggcgacgccgagcccggagtgcccccgggagccggtggtgctggcggcgccggcaccaccggcggcaagggtggcaccggcggcaacggcagtggcaccggctcgggcggcaccggcggcgatggcggcaccggcggtggtggtgggaacggcggcaccggctggaatggcggcaagggagacaccggcagcggcggtggcgccggagacggtggtaaggcaccagccggtggcaccggcggcgccggcggcgacggcggagcgggcggcaagggcggcagcggcggcgtctag

SEQ ID NO: 530 - DNA, 4617 bp, Mycobacterium tuberculosis H37Rv
atggtcatgtcgctgatggtggcgccggagctggtggcggcggccgcggcggacttgaccgggattgggcaggccatcagcgcggcgaatgcggcggcagcgggcccgacgacgcaggtgttggcggccgccggtgatgaggtgtcggcggcgatcgcggcgttgtttggtacccacgcgcaggagtaccaggcgttgagcgcccgggtggcgacgtttcatgagcagtttgtgcgctcgctgaccgcggctggcagcgcgtatgcgactgccgaggcggcgaatgcatcaccgctgcaggcgctggagcagcaagtgttgggtgcgatcaacgcgcccacacagctgtggttggggcgcccgctgatcggtgatggcgttcacggggcgccggggaccgggcagcccggtggggccggggggttgttgtggggtaatggcggtaacggcggttcgggggcggccggtcaagtcggtgggcccggcggcgcggccgggttgttcggcaacggcgggtccggcgggtccggcggggccggcgctgccggcggtgtcggcggatccggcgggtggttgaacggcaacggcggggccggcggggccggcgggaccggcgctaacggtggtgccggcggcaacgcctggttgttcggggccggcgggtccggcggcgccggcaccaatggtggcgtcggcgggtccggcggatttgtctacggcaacggcggcgccggcgggatcggcggcatcggaggtataggcggcaacggtggcgacgccgggctgttcgggaacggcggcgccgggggggccggggccgcgggcctgccgggtgccgccggcctcaacggcggcgacggcagcgacggcggcaacggcggaaccggcggcaacggcgggcgcggcgggttattggttggcaacggcggggccggcggggccggcggcgtcggcggcgacggtggtaagggcggcgctggcgatccgagtttcgccgtcaacaacggtgccggcggtaacggcggtcacggcggcaaccccggcgtgggcggggccggtggggccggcggcctgctggcgggtgcgcacggtgccgccggcgccacccccaccagcggcggcaacggcggcgatggcggcatcggcgccaccgccaactcacccctacaagccggcggggccggcggtaatggcggtcatggcgggttggtcggcaacggcggcaccggcggcgccggcggtgccggtcatgcgggttccaccggcgctaccggtaccgccttacaaccgacgggcggtaacggcaccaatggcggcgccgggggccacggcggtaatggcggaaatggcggcgcccagcacggcgacggcggcgtcggcggcaagggcggtgccggcggtagcggcggcgccggcggaaacggattcgacgccgccaccttgggttcgcccggtgccgatggcggtatgggcggcaacggcggcaagggcggtgacggcggcaaggccggtgatggcggagccggtgccgccggtgatgtgaccttggccgtcaaccagggtgccggcggtgacggcggcaacggcggtgaagtgggcgttggcggcaagggtggggccggcggtgttagcgcgaacccggccctgaacggttcggccggggcgaacggcaccgcgcccaccagcggcggcaacggtggcaacggaggtgccggcgccacccccaccgtcgcgggagaaaacggcggcgccggtggtaacggcggccatggcgggtcggtcggtaacggcggtgcgggtggtgccggcggaaatggcgtcgccggcaccggccttgccctcaacggcggcaacggcggcaacggcggcatcggcggcaacggcggatcggcggccggcacgggcggggacggcggcaagggcggcaacgggggcgccggagccaacggccaagacttctccgcgtccgccaatggcgcgaatggcggacagggcggcaacggcggcaacggcggcatcggcggcaagggtggtgacgccttcgccacgttcgctaaggccggcaacggcggtgccggcggcaacggcggcaatgtgggcgttgccggccagggtggggccggcggcaagggcgccattccagccatgaagggtgcgaccggcgccgatggcaccgcacccaccagcggcggtgacggcggcaacggcggcaacggcgccagccccaccgtcgcgggcggcaacggcggtgacggcggcaagggcggcagcggcgggaatgtcggcaatggcggcaatggcggggccggcggcaacggcgcggccggccaagccggtacgccgggccctaccagcggtgattccggcacctcgggcaccgacggtggggctggcggcaacggcggggcgggcggcgccggcggaacactggccggccacggcggcaacggtggtaagggtggtaacggcggccagggtggcatcggcggcgccggcgagagaggcgccgacggcgccggccccaatgctaacggcgcaaacggcgagaacggcggtagcggtggtaacggtggcgacggcggcgccggcggcaatggcggcgcgggcggcaaggcgcaggcggccgggtacaccgacggcgccacgggcaccggcggcgacggcggcaacggcggcgatggcggcaaagccggtgacggcggggccggcgaaaacggcctaaacagcggggccatgctgccgggcggcggcaccgtaggaaaccccggtaccggcggcaacggcggcaacggcggcaacgccggcgtcggcggcaccggaggcaaggccggcaccggctccttgacgggcttggacggcaccgacggcatcacccccaacggcggtaacggcggcaatggcggcaacggcggcaagggcggcaccgccggcaacgggagcggcgcggccggcggcaacggcggcaacggcggctccggcctcaacggcggtgacgccggcaacggcggcaacggcggtggggcgctgaaccaggccggcttcttcggcacgggcggcaaaggcggtaacggcggcaatggcggtgccggcatgatcaacggcggcctcggcggcttcggcggcgccggcggtggcggcgccgttgacgtcgccgcgacaacgggcggcgctggcggcaatggcggtgccggcggcttcgctagcaccgggttgggtggcccaggcggcgccggcggtcccggcggcgcgggcgactttgctagcggtgttggcggtgtcggcggcgccggcggggacggcggtgccggcggggtcggcggcttcggcggccagggcggcatcggcggggaagggcgcacaggcggcaacggcggtagcggcggcgacggcggtggcggcatttccttaggcggcaacggcggcctcggcggcaacggcggcgtctccgagactgggtttggcggcgccggcggcaacggcggctacggcggtccgggaggccccgaaggcaatggcggcctcggcggcaacggcggcgccggcggcaacggcggcgtcagcaccacgggcggcgacggcggcgccggcggcaagggcggcaacggcggcgacggcgggaacgtcggtttgggcggtgacgccggctccggcggcgcgggcggcaatggcggtatcggcaccgacgcgggcggtgccggaggggccggtggcgctggcggtaacggcggtagcagcaaaagcacgaccaccggcaacgccggctccggtggtgccggcggtaatgggggcactggcctcaacggcgcgggcggtgctggcggggccggcggcaacgcgggtgtcgccggcgtgtccttcggcaacgctgtgggcggcgacggcggcaacggcggcaacggcggccacggcggcgacggcacgacgggcggcgccggcggcaagggcggcaacggcagcagcggtgccgccagcggctcaggcgtcgtcaacgtcaccgccggccacggcggcaacggcggcaatggcggcaacggcggcaacggctccgcgggcgccggcggccagggcggtgccggcggcagcgccggcaacggcggccacggcggcggtgccaccggcggcgacggcggcaacggcggcaacggcggcaactccggcaacagcaccggcgtcgcgggcttggccggtggtgccgccggcgccggcggcaacggcggcggcacttccagcgccgccggccacggcggcagcggcggcagcggtggcagcggcaccacgggcggcgccggcgcggccggcggcaacggcggcgccggtgctggcgggggcagcctgagcacaggccagtccggcggcccacggcggcagcggtggtgccggtggcaacggcggcgctggctcggccggcaacggcggcgccggtggtgccggtggcaacggcggtgccggcggcaacggtggcggtggcgatgccggcaacgccggctcaggcggcaatggcggcaagggcggcgacggtgtcggccctggctccaccggcggcgcgggcggcaagggcggcgctggcgccaacggcggttccagcaacggcaacgctcgcggtggcaacgccggtaa

SEQ ID NO: 531 - DNA, 2772 bp, Mycobacterium tuberculosis H37Rv
atgtccttcgtggtcacagcaccgccggtgctcgcgtcggcggcgtcggatctgggcggtatcgcgtccatgatcagcgaggccaacgcgatggcagcggtccgaacgacggcgttggcgcccgccgccgccgacgaggtttcggcggcgatcgcggcgctgttttccagctacgcgcgggactatcaaacgctgagcgtccaggtgacggccttccacgtgcagttcgcgcagacattgaccaatgcggggcagctgtatgcggtcgtcgacgtcggcaatggcgtgctgttgaagaccgagcagcaggtgctgggtgtgatcaatgcgcccacccagacgttggtgggtcgtccgctgatcggcgatggcacccacggggcgccggggaccgggcagaacggtggggcgggcggaatcttgtggggcaacggcggtaacggcgggtccggggctcccggacagccgggcggccggggcggtgatgccggcctgttcggccacggcggtcatggcggtgtcggggggccgggcatcgccggtgccgctggcaccgcgggcctgcccgggggcaacggcgccaacggcggaagcggcggcatcggcggcgccggcggcgccggcggcaacggcgggctgctattcggcaacggtggtgccggcggccagggtggctccggcggacttgggggctccggcgggacgggcggcgcgggcatggctgccggtcccgccggcggcaccggcggcatcgggggcatcggcggcatcggcggcgcgggcggggtcggcggccacggctcggcgttgttcggccacgggggaatcaacggcgatggcggtaccggcggcatgggtggccagggcggtgctggcggcaacggctgggccgctgagggcatcacggtcggcattggtgagcaaggcggccagggcggcgacgggggagccggcggcgccggcgggatcggtggttcggcgggtgggatcggcggcagccagggtgcgggtgggcacggcggcgacggcggccagggcggcgccggcggtagtggcggcgttggcggcggcggcgcaggcgccggcggcgacggcggcgcgggcggcatcggcggcactggcggtaacggcagcatcggcggggccgccggcaatggcggtaacggcggccgcggcggcgccggtggcatggccaccgcgggaagtgatggcggcaatggcggcggcggcggcaacggcggcgtcggtgttggcagcgccggaggggccggcggcaccggcggtgacggcggggcggccggggcgggcggcgcgccgggccacggctacttccaacagcccgcgccccaagggctgcccatcggaaccggcgggaccggcggcgaaggcggtgccggcggcgccggtggagacggcgggcagggcgacatcggcttcgatggcggccggggtggcgacggcggcccgggcggtggcggcggcgccggcggtgacggcagcggcaccttcaatgcccaagccaacaacggcggcgacggtggtgccggcggtgttgggggagccggcggcaccggcggcacgggtggggtcggggccgacgggggtcgcgggggggactcgggccgcggcggcgacggcggcaacgccggccacggcggcgccgcccaattctccggtcgcggcgcctacggcggtgaaggtggcagcggcggcgccggcggcaacgccggtggcgccggcaccggtggcaccgcgggctccggcggtgccggaggtttcggcggcaacggtgccgatggcggcaatggcggcaacggtggcaacggcggcttcggcggaattaacggcacgttcggcaccaacggtgccggcggcaccggcgggctcggcaccctgctcggcggccacaacggcaacatcggcctcaacggggccaccggcggcatcggcagcaccacgttgaccaacgcgaccgtaccgctgcagctggtgaataccaccgagccggtggtattcatctccttaaacggcggccaaatggtgcccgtgctgctcgacaccggatccaccggtctggtcatggacagccaattcctgacgcagaacttcggccccgtcatcgggacgggcaccgccggttacgccggcgggctgacctacaactacaacacctactcaacgacggtggatttcggcaatggccttctcaccctgccgaccagcgttaacgtcgtcacctcgtcatcaccgggaaccctgggcaacttcttgtcgagatccggtgcggtgggcgtcttgggaatcgggcccaacaacgggttcccgggcaccagctccatcgttaccgcgatgcccggcctgctcaacaacggtgtgctcatcgacgaatcggcgggcatcctgcagttcggtcccaacacattaaccggcggtatcacgatttctggagcaccgatttccaccgtggctgttcagatcgacaacgggccgctgcaacaagctccggtgatgttcgactccggcggcatcaacggaaccatcccgtcagccctcgccagcctgccgtccgggggattcgtgccggcgggaacgaccatttcggtctacaccagcgacggccagacgctgttgtactcctacaccaccaccgcgacaaacaccccatttgtcacctccggcggcgtgatgaacaccgggcacgtccccttcgcgcagcaaccgatatacgtctcctacagccccaccgccatcgggacgaccacctttaactga

SEQ ID NO: 532 - DNA, 2250 bp, Mycobacterium tuberculosis H37Rv
ttgatcggcaacggcggggccggcgggtccggggcgcccggcgccatcggtggggccggcgggcccgcggggttgatcggtgtcggaggtgccggcggggccggtggagactccgcggtcgcgggtgtcatcggaggggccggtggggcaggcggggctgccctgctgttcggtgccggtggggccggcggggccgggggttccggcggttccggcgcagctggtggggccggtggcgccggtggggccggcgggctgttcgccagcggcggcagcggcgggttcggcgggttcgcatcgacgggcaccggtggggccggcggcaccggtggggctggtgggttgttcgccagcggcggggtcggcggtactggcgggggagccgggtccggcggtaccggtggggttggtgggacgggtggggccggagggctgttcgctagcggcggcgctggcggggccggcgggtccggcggtaccggtggggctggtgggacgggtggggccggcgggctgttcggagccggtggcgctggcgggctcggcgggcaaggcaaccacaccggcgggcacggtggggccggtggcagcgccggcctgctcgcccttggcgacggcggcgctggcggggccggcggggccgctaccaccggaaccggcggggccggcggggcgggtggcaaggccggcctgctgttcggctccggtggggccggtgggtccggtggggctgccggcaccttcggtgacaccggtaactccggcggggccggtggggcgggtggcaaggccggcctgctgttcggctccggtggggccggtgggtccggcggcgctgggggcttcgccaacggctctaccggcggtgccggcggggccggcggcggggccgggctgatcggcaacggcggcaacggtggcagcggcggcacgtcggttgccaccgggggggccgggaacggcggtgccggcggcgccggcggcggggccgggctgatcggcaacggcggcaacggcggcagtggcggaatgggcgatgccccgggcggcaccggcgtcggcggcatcggtgggctgttgttgggtttggacggcgccaacgccccggccagcaccaacccgctgcacaccgcgcagcagcaggcgttggccgcagtcaacgcgcccatccaggccgtgaccgggcgcccgctgatcggcaacggcgccaacggcgccccgggcagcggggcccccggcgggcacggcgggtggttgttcggcggcggagggaccggcgggtccggcgtcagcggcggggcgggcggagatggcggggccggcgggatcttgttcggcgccggcggggccggcggcgcgggcggggccgtcacgggaaccggcgccaccggcgggtccggtggggccggcggtggagccttgctgtttggggccggtggggccggtggagccggcgggtccagcgggattggcgggttcgccgcgggcggggccggtgggcccggaggggccggtgggctgttcaacggcggcggggccggcggggccggcgggtccggcgtcagcggcggggctggcggggagggcggggccggcggggccggtggcctgttcgccggtggcggggccggcggggccggcggatcgggcaacaacgtcgggggggccggcggggccggtggggtcggtgggctgttcggggccggcggggccggcggatccggcggcggcggtagcgttgctggcgacagtggggccggcggcaacgcgggcttgctcgcccccggtctcgccggcggtgccggcggtggcggcgggcagggttttgacaccggcggggccggcgggcccggcggcgacgccggcctgctggtcggctccggcggggtcggaggtgccggcggattcggcctcactacgggtgggcctggggcggccggcggcgacgccggcctgctgttcggctccggcggcgctggcggggccggcggctccggccgaaccgacctcggcggcgctggcggagccggcggcaaggccgggctgatcggcaacggcggtaacggcggggccggcggggccggcgggaacggcggcggggacggcgggcccggtggagccgccttcgggctcggtaacggcggcaacggcggcaacggggggaccggcacgtccgcgggcagccccggtgccggcggcgccggtggttcgctgatcggcgcggaggggctgcccgggctgctgccctag

SEQ ID NO: 533 - DNA, 2562 bp, Mycobacterium tuberculosis H37Rv
atgtcgtttgtgattgctgcgccggaggcgttggtcgcggtcgcttcggatctggcgggcattgggtcggcgctggcggaggccaacgccgcggcgttggccccgacgacggcgttgttggccgcgggtgccgatgaggtgtcggcggcgatcgcggcgctgtttggcgcgcacgggcaggcgtatcagacggttagcgcccaggcgtcggcgtttcatgcccagtttgtgcaggcgttgactggcggcggcggggcgtatgcggctgccgaggccgccaacgtctcggcggcgcagagcaccgaccagcggctgctcgatctgatcaatgggcccacccaggcgttgttggggcgtccactgatcggtgatggcgccaacggcgggccggggcaagacggcgggcccggggggttgctgtacggcaacggcggcaacggcggcactagtaccaccgccggggtggccggcggcaacggtggcgccgccgggctgatcggcaacggcggggccgggggcggcggcggggccggcgcggccggcggcaatggcggtgcgggcgggtggctgtatggcaacggcggcgccggcggggccggtgggacatcggtgatacccggtgtcgccggcggcaatggcggggctggcgggtccgcgggactgtggggtaccggcggggccggtggcgacggcggcaacggccggtcggggccagtcaacgtcgccggcagcgcgggcggcaacggtggcgctggtggcgccgccgggttattcggtgacgccggggccggtggcaacggcggcaagggcggtgctggcggcgccgcctttagcattaacttcaccgcaggcgatggcggtgcgggaggtgccggtgggtccggcggccacgcattgctgtggggcgccggcggagccgggggtaacggcggatccggcggcacggggggtgccggcggcagcaccgctggcgctggcggcaacggcggggccgggggtggcggcggaaccggtgggttgctcttcggcaacggcggtgccggcgggcacggcgccgccgccggaaacggcttagccgcgggtaatggcgtcagcagcagcggcggcggcggtgccggtgggaccggcggggccggtggggacggtggcgccggcggggccggaggcaacgccaggctgtggggcgtcggtggcgccggcggggccggcggggacggtggcgccggcggggccggcggcaaaggcggctctggcctcagcggtaacgccaacggcggggccggcggcgacagcggccgtggcggcacgggcggcgccggcggcgagggcggcgccgccgggctgctggtgggcaccggcgggcacggcggtgacggcggggccggcggcgccgccgtcaagggcggtgacggcggggccgccgccggcacgggcatcgccggcgctggcggccgtggcggcgcgggcggcagcggtggcagcggtggtgacggcgggggcggggccgccggccccgccgggtggctgttcggcgatggcggggctggcgggaacggcggggccgcggccgccggcggcgccggcggccaagccggcggtggcggcgggaacggcggcaatggcggcaacggcggcaatggcggcaatggcggcaacggcgccaccggggggtggctgtacggcaacggcggggccggcggccagggcgccaccgccggagccggcggagccggcgctaacggcgtcagcagcaccaatggcggcggcaccggcggcaacggggggatcggcgggaccggtgggtccggcggggccggtggcaacgccgggctgttgggcgtgggcggcgccggcgggcacggcgcctccggcggcgccggcgataggggcggcgctggcggtaccgggttcataagcagtgacggcggtgctggcggtgatggcggtgatggcggcaacggcggggccggcggcaccggtgggctgttgttcggtgccggcggcaatggtggccccggcgggtctggcggtgccgccgatattggcggcaacggcggcgccggtaacggcgggggcaccgacgggaacggcggtaatggcgggtccggcggcggcgccggcagcggcggtgacggcggcggggctggcggcaacggtgcgtggctgttcggcaatggcggcgccggcgggggcggcggaaaaggcggcaacggtgccggcggcgggcttggcggcggttcattcggcctccccggcctgaacggcagcggcggcgacggtggcgacggcggtaacggtgcccccggcggggtgctgtatggcaatggcggcgccggcggccaggggtcaagcggtggcatcggcggccccggcgccaccggcggtgccggcggcaaaggcggtgatggtggcgatgcgcagctgatcggcgacggcggcaatgggggcaacggaggcgcgggcggcaccgggggcaccccggggcccggcggacccggcgggtccggcgggcttggaggcctgctgttcggccaaaccggcacggctggcgtgtcgccgtag

SEQ ID NO: 534 - DNA, 1857 bp, Mycobacterium tuberculosis H37Rv
atgtcctatctcgtcgtggtgccggagttggtcgcagcggcggcaacagatttggcgaacatcggttcgtcgattagtgcagccaacgcggccgcggcggcaccgaccacggcactggtcgcagccggcggcgacgaggtatcggcggccatagccgcgttgttcggagcgcatgctcgggcatatcaagcgttgagtgcccaggcggcgatgtttcatgaacagtttgtccgggccctcgccgccggcggtaactcctacgccgtcgctgaggcggcaaccgcgcaatcggttcagcaagatctgctcaacctgatcaatgcgcccacccaggcgctgttggggcgtccgctgatcggcaacggcgccaacgggctgccgggtacgggccagaacggcggcgacggcgggattctgtacggcaacggcggcaacggtgggtccggcggggtcaaccaggccggtggcaatggcgggaatgctgggctgtggggcaatggcggatccggcggagccggcgggaacgccaccactgccggccgcaacggcttcaacgggggcgccgggggaagcggcggtttgctgtggggcaatggcggtgccggcggggccggtgggaacggcggtccggctccgctcgtgggcggggtgggcaccaccggtggcgccggcgggaacggcggcggcgccgggttgttctacggtttcggcggcgccggtgggaacggcgggatgggcggggtggcaccgagcaccggcccctcgatgggcatcctcccggccggcggtgtcggcgggcctggtggctccggcggggcgagcgcgcttgccttcggctccggcggcgtcggcggtgccggtggcttgggcgggccgaccgatggcaccgtccagggggtgggcggcttcggcggtcagggcggcaacggcgggcagagcggcttgttgtttggcaacgcgggagccggcggggcaggcgctgccggcggagccggcaccggcgacaccgagagcttcggcggccacggcggggccggcggtgatggcggcgctgttggcttgatcggtaacggcggggccggcggcaccggatctcccggcgctgtggtgggtggtaacggcggcgtcggtggtctgggtggcgccggcagtcccgggggtctgttgtacggcaccgggggggccggcggcaatggcggaccgggtggtgacggtggtactggcgcgacggtgggctttgccggctccggcggtttcggcggtgcggggggcatcgcccagctgtttggcacgggtggcatgggtggtagcggcggtggtataggcgctggcaccacgaccgtggtgccgcccgacgtcgccccggtgggtggcacaggcggcaatggcggtcgcgccgggctgctgttgggtgtgggtggcatgggcggtaatggcggtgccaccagcgtcggcgggacgctctacgccgccggtggaaacggcggcgacggcgggttggtgtggggcaacggtggcaccggcgggagcggtggcgccggcggggcgggcagcgtcggcaacggcggtgcgggtggcaacgcggcactgctgttcggcaacggcggggcgggcggggccggcggcgccggcggcatcggtgccggcggagccggcggcttcggcgcggttctgtttggcaacggcggggctggcgggagcggtgcccccggtggcatcggcgccggtggcaatggcggaaacgcgctgctggtcggcaacggcggcaacggtggggcaggtaccggtggggctgctggcggtgccggtggctcgggcgggttgctattcggccaaaatgggatgcccgggccgtga

SEQ ID NO: 535 - DNA, 3162 bp, Mycobacterium tuberculosis H37Rv
atgaatttttctgtactgccgccggagatcaattcagcgctgatattcgccggggcagggccggaaccgatggcggcggccgcgacggcctgggacgggttggccatggaattggcctcggccgcagcctctttcggctcagtgacatccggactcgtgggcggggcgtggcagggcgcgtcgtcgtcggcgatggcggcagcggcagccccctatgcggcgtggcttgccgcggcggcggtccaggccgagcagacggccgctcaggctgcggcgatgatagccgagtttgaagcggtcaagacggcggtggtgcagccgatgctggtggcggccaaccgtgccgacctggtgtcgctggtgatgtcgaacctgtttggacagaacgctccggcgatcgctgccattgaagccacgtacgagcaaatgtgggctgccgatgtgtcggcgatgtctgcctaccatgccggggcatcggcgatcgcctcggcgctgtccccgttcagtaaaccgctgcagaacctggctggcttgccggcttggttggccagcggcgcgcctgcggccgccatgaccgcagccgcaggcataccggcgcttgcgggcggacccaccgccatcaacctgggcatagccaacgtcggcggtggcaacgtcggcaacgccaacaacggccttgccaacatcggcaacgccaaccttggcaactacaatttcgggtccggaaatttcggtaactccaatatcggctcagcaagcctgggtaataacaacatcggcttcgggaacctcggcagcaacaatgtcggcgtgggaaaccttggcaatctcaacaccgggtttgccaacaccggcttgggcaacttcggctttggcaacactggcaacaacaacatcggcatcggtcttaccggcaacaaccagatcggaatcggcgggctcaactcgggcaccgggaatttcggattgttcaactcgggcagcggaaacgtcggcttcttcaactccggcaatggaaactttggcatcggaaactcgggtaatttcaacaccggtggctggaattctggacacgggaacacgggcttcttcaatgcgggctcgtttaacaccggtatgttggacgtcggcaacgcgaacacaggcagcctgaacaccggcagttataacatgggcgacttcaatccggggtcgtccaacaccggcacgttcaacacgggaaatgctaacacgggtttcctcaacgccggaaatatcaacactggtgtcttcaatattggccacatgaataatgggctgttcaacacgggtgacatgaacaatggcgtcttctaccggggcgtggggcagggcagcctgcagttcagtattacgacacctgatctgactctgccgccgctgcaaataccggggatatcggttcccgccttcagtctgccggcaataacgctgccgtcgctgaacatcccggccgccaccacaccggccaacatcaccgtcggcgccttcagcctgcccgggttgacgttgccgtcgttgaacatcccggccgccaccacaccagccaacatcaccgtgggtgccttcagcctgcccgggttgacgttgccgtcgttgaacatcccggccgccaccacaccagccaacatcaccgtcggcgccttcagcctgcccgggttgacgttgccgtcgttgaacatcccggccgccaccacaccagccaacatcaccgtcggcgccttcagcctgcccgggttgacgttgccgtcgttgaacatcccggccgccaccacaccagccaacatcaccgtcggcgccttcagcctgcccgggttgacgttgccgtcgttgaacatcccggccgccaccacacccgccaacatcaccgtaagcggctttcagttgcctccgctgagtattccttccgtagccattccgccggtgacggtcccgcccattacggtgggtgcttttaatttgccgccattgcagattccggaagtaactattccgcagctgacgatacccgcgggtatcacaatcggtggctttagtctacctgcgatacatactcaaccgataacggtcggccagattggcgtgggccaatttggcctgccctccataggctgggatgttttcctaagcacacctaggataacagtaccggcttttggaataccctttaccctacaattccagaccaatgtgcctgcgcttcagccgcccggcggcgggcttagtactttcaccaatggcgccctcatcttcggtgagtttgacttaccacaattggtggttcacccatacacattgaccggccctattgtcatcggttcattctttctgcccgccttcaacatacccgggatcgatgtccccgctatcaacgtcgatggcttcaccctgccgcagatcaccaccccagctatcaccaccccggagttcgcgatccctccgatcggcgtgggcggcttcactctgccgcagatcaccacccaggaaatcatcaccccggagctaaccatcaactcgatcggcgtcggcgggttcaccctgccgcaaatcaccaccccacccatcaccaccccaccgctgaccatcgaccccatcaacctcaccggcttcaccctcccccaaatcaccaccccacccatcaccaccccaccgctgaccatcgaccccatcaacctcaccggcttcaccctcccccaaatcaccaccccacccatcaccaccccaccgctcaccatcgagccgatcggcgtggggggcttcaccacgcccccgctcaccgttcccggcatccacctgcccagcaccacgatcggggccttcgcgatccccggggggccgggctacttcaactcgagcaccgcgccttcgtcgggcttcttcaattccggtgcgggcggcaactcgggcttcggcaacaacggctcgggcctctcgggttggttcaacaccaacccggccgggctgttgggcggctcgggctatcagaacttcggcgggctatcctcgggcttttccaaccttggcagcggcgtctcaggcttcgccaacaggggcatcctgccgttctcggtagccagcgtcgtttccggctttgccaatatcggcaccaacctggcgggtttcttccaaggcaccacgtcctaa

SEQ ID NO: 536 - DNA, 1848 bp, Mycobacterium tuberculosis H37Rv
atgttgtatgtagttgcgtcacccgacttgatgaccgcggcggctaccaatctggcggagattggttcggcgatcagcacggcaaatggtgcggcggcactcccgactgttgaggtggtggccgcggccgccgacgaggtgtccacgcagatcgcggctctattcggagcgcatgccaggagctaccaaaccctcagcacccaggcagcggcgtttcatagtcggtttgtgcaggcgttgaccacggccgcggcttcctacgccagcgtagaggccgccaacgcgtcgccacttcaggttgcgctagacgtgattaatgcgcccgcccagacactgctcggacgtccgctaattggtaacggcgccgacggatcgacaccggggcaggccggcgggcccggcgggttgctgtacggcaacggcggtaatggcgccgccggtgggcccaaccaggccggcggcgccggcggcaacgccggcttgatcggcaacggcggggcgggcggcgccgggggtgttggcgcggtcggcggtaaacgcggcacgggcggcctgctattcggcaacggcggggccggcgggcaaggcgggctcggcctcgcaggtatcaacggcggcagcggcgggcagggaggccacggtggcaacgccatcctgttcggccagggcggtgccggcgggccaggtggcaccggcgccatgggcgtcgccggcaccaatcccacccccatcggcaccgcagcgcctggcagcgacggcgtaaatcagattgggaacggtggtaacacggacctcaccggcggcgccggtggcgacggcaatgccggcagcaccaccgtgaacggcggcaacggcggtaccggcggcgcagctaggaactcatctggtggtaccggtaactcctttggtggtgccggcggcgccggaggcgacggcgccaacggcggcgacggtggcgctggcggggaagccctcaccgaaggcggtgccaccgccgttagtggtgctggtggtaagggaggtaacgccgaggcttccggcggcgccggcggcaacggcggcaaaggtggctttgctcaggccaccaccagcgtgaccgggggtaacggcggtaacggtggcaatggccacgacagtaacgcgccgggcggcgctggcggcagcggtggcgtcggcggtgacggcggccgtggcggcctgctggccggcaacggcggcaccggcggtgccggtggcaacggcggtaccggtggcgccggtgcccccggcggtgccggcggcgccggcggcaaagccgacatcgccaacagcctcggcgacaatgccaccgtaaccgggggcaatggcgggacaggcggagacggcggcagcgcgctgggcaccgggggggctgggggtgccggaggtctaggtggtcacgggggtgcaggcgggctgctgattggcaacggcggcgccggtggcgctggcggcctcggcggtgcgggcggcgccggcggtgcgggcggtgagggcggtgccggcggcgccggaggcgaagctattcccggcggggcgtccaccaactccgccggcggtgacggaggggcgggcggtactggcggcaatggcggtgacggcggtgccggcggagcccccggcctcggtggcgcgggcggggccggcggatggttgatcggccagtcgggcagcaccggcggcggtggcgccggcggtgccggtggtgccggaggtgccggtggcgcgggcggcagcggcggtgcgggtggccatggcgacactacctccggcaagaacggttcgtctggcaccgcgggcttcgacggcaaccccgggcagcccggctga

SEQ ID NO: 537 - DNA, 2964 bp, Mycobacterium tuberculosis H37Rv
atgcattactcagtgttgccgccggagatcaactcggccttgatcttcgccggggcgggctccggaccgatgctggcggcggcgtcggcctgggacgggctggcaaccgaattagcctcggctgctgtctctttcggctcggtgacagccgggctggtcggcgggtcgtggcagggtcggtcatcggtggcgatggcagcggcggcagccccgtatgcggggtggctggccgcggcggcgacccaggccgagcaggcggccacccaggcccaggtgatggtggccgagttcgaggctgtgcggctggcgatggtacaaccggcgctggtggccgccaaccgttccggcctcatatcgctggtgatatcgaacctttttggtcaaaacgctcccgcgatcgcggccgccgaagccgcatacgaggagatgtgggctctggatgtatcggcgatggcggcctaccattccggggcgtcggcggtcgctgtggcgctaccggcattcgccctcccgctgcggcttccggcgggtctggcggccgggcccgcggccgtggtgaccgcgctcaccacggccgtgggcatgccgacttttgccggccgggcgatcgccgctagcctcggcttggccaacgtcggtggtggcaacctcggcaatgccaacaatgggctcggcaacatcggcaacgccaaccttggcaacaacaatctggggtccggcaacttcggtagcttcaatatcggctcggccaacctaggtggcaacaacatcggcataggaaacgcgggcgccaacaacttcggacttgcaaacctgggcaatttgaacacgggattcgccaatgcaggcatcggcaacttcggaattgcgaacaccggcaacaacaatatcggcaacggcctgactggaaacaaccaaatcggcattggcggactcaattccggcaacggtaacgtcggattattcaacgcgggtagcgccaatatcggtttcttcaactccggcaatggcaactttggcatcgggaactccggtaacttcagcactggcctgttcaaccccggacacggcaacaccggattcctgaatgcgggctctttcaatacgggcatgttcgacgttgggaacgcgaacaccggcagcttcaacgtcggccactacaacttcggtgccttcaacccgggcccgtcgaacacgggtaccttcaacacgggcggcgccaacaccggctggttcaacacaggaagcatcaacaccggcgccttcaacataggcgacatgaataacggcttgttcaacacgggcgacatgaacaatggtgtcttttaccgtggtgtgggccaaggcagcctgcagttcgccatcaccagccctgatttgacgcttccgtctctggaaatacccggaatctcggttcccgcgttcagcctgcccgcgataaccttgccgtcgttgacgattccggcggtgacgacgccggccaacgttaccgtgggtgcgtttgatttgccggggttgacggtgccgtcgttgacgattccagcggcgatgacgccagctaacatcacggtgggtgcgtttgatttgccggggttgacggtgccgtcgttgacgattccagctacaacgacaccagccaacatcacggtaggtgcgtttaacttgcctcagttgagtattccgtcggtgacggttccgccgatcacgattccggctggcacagcgctaggtgcgttcaatctgccgacgctgagtattccgtcggtgacggttccgccgatcacgattccggctggcaccactgtcggcggatttacgctacccacgatacacaccccgttaataagtacaccccaaataagtataggcggctttagcactcccggcatagccacgcaagcaaattctggtgtcatcaatcttcccacctttagccttaacggcattacgataactaatttggtggtgttcattccgaacaacatcactgccttgcaaaccaatatgcccggggtattcccgcagattggcggcttcgctaatacacctcctgcctttattaatactgggaccattaccgtgggtggaggtcaaatcaacggcgtcggcttctcgatcggcgcaatcaacgtcacccccttcaccctccccaacgtcgtcatccaaccgtggtccctcggggggatctcggtcgacgggttcaccctgccagagatcagcacccaagaattcaccactccggcgttgacgatcagtccgattggtgtcggtgcattgagcctgccggatatcactactcaacagttcacgaccccggagttgaccatcgacccgatcacgctgggtgggtttacgctgccgcagctcagcatcccggcgattaccaccccggcgttcacgatcgatccgatagcgctgggtggtttcacgcttcctcagatcatgacgcccgagataacgactccaccgttcgccatcgacccgatcggacttagcggtttcaccctcccccaggtcaatatcccggagatcaccacgccagagttcaccatccagccggtgggcttggcggccttcaccacacccgcactcaccatcgccagcatccacctgccgagcaccaccatgggcggattcgcaatcccagcggggccgggatacttcaactcgagcgcaacgccctcgttgggctttttcaacgccggaatcggtgggaactcgggcttcggcaacagcggctcgggactgtcgggttggttcaacacaagtcctgttgggctgctagccggctcgggctaccagaactacggtggtcttatctccggcttctccaaccttggcagcggcatatcgggcttcgccaacaccggcaccctgccgtttgccgtgaccagcttggtctccggtttggccaacatcggcaacaacctgtcgggcctgttcttccagagcaccacgccataa

SEQ ID NO: 538 - DNA, 2304 bp, Mycobacterium tuberculosis H37Rv
atgtcgtttgtagtcgtggcgccggaggtgttggcggcggccgcttcggatctagcgggcatcgggtcgacactggcgcaggccaacgccgcggcgttggcgccgaccaccgcggtgttggccgcgggtgctgatgaggtttccgcggcaatcgcgtcgctgtttggggcgcatggtcaggcgtatcaggcggtgagcgcccaaatgtcggcgtttcacgcccagttcatgcaggcgttgacgggtgccggcggggcttatgcggctgcggaggcggtcaacgtctcggcggcgcagagcgtggaacaagacctgttggccgcgatcaacgctcgcttcgagcggatttttgggcgcccgctgatcggtgatggcgccaacggcgggccgggacaagacggcgggcccggcgggttgctgtacggcaacggtggcaacggcggcaccagcacgaccgtggggatggccggcggcaacggtggtgccgccgggctgatcggcaacggtgggttcgggggcggcggcgggcccggcgcggccggcggcaacggcggcgccggcgggtggctattcggcaacggcggcgccggcggtgccggcggcctcggcgtagcgcccggcgtgcccggcggcgccggcggtgccggcggcgccggcggtgtcggcggacccgccgggttgtggggccacgggggtgccggcggggcgggtggtgccggcgtggctggcgccggcggcttcgaggggacgatcggtgccggcggtgccggcggtgtcggcggtgccggcggtgtcggcggtgccggcggtgccggcgggtggctgtacggcgacgccggtgccggtggggatggtggtgtcggcggtgccggcggcaccggcgggttaggcaaccgtggcggcgccggtggcgccgggggcgccggtggtgtcggcggcgccgggggtgccgccgggctgtggggcggcggtggtgccggcggggtgggtgggaccggcggcggcgccggcctcggtgctcagagcgtcaccttcagtagtagcttaagtggcctttccggtggcgacggcggcgccggcggggccggtggcgccggtggcgccggtggcaccggtgggtggctgtatggcggcggtggtgccgccggatccggcggggacggtggtaccggcggtcagggcggcgccggcggcgccggtgtatttagcctattcggatccggtggcggccccggcggcaacggcggcgtcggcggcgtcggcggtgtcggcggtgctggcgggcgtgccggcttgttcggcgtcgggggcctcggcggcgcgggtggcgacgccggtgactccggcgaaggcggcttcggcgggccggggctcgccggcgggctgttcggcaaccccggcaacggcggcgtcggcgggatcggcggcgacgccgcagccggcggcgccggtggggccggaggcaacggtggggccggaggcaacggtgggtggttgttcggcaatggtggtgccggcggctccggtggcgacggcggcgccgccggccgtggcggtgccggcaacttgggctcggccgggggtatcaacgcccccgccggtaaccccggcagcggctcggtcggcatcggcggtgccggtggtgccggcggcaccgccgggctgttcggcgacggtggggctggtggggccggtggtgccggcgccgccggcggcttcggcggcatcagcgccgccaccccctcggcgggcagtgagggcgccatgggtggggccggtggtgttggcggcaacgccaggctgttgggcactggtggcgccggtggagtcggcggcggcggcggggccggcggcgacggaggccgcggcggagtcgcaacccccggcggtcagggcggtgacgctggggacggtggcgccggcggggccggcggcaatggcggcggcgccagcggcgccggcgggtggctgttggggaccggtggtgccggtggtgccggtggtaacggcggcaatggcggaaaagccggttttagccctgggccgaccaacttcggtctcaacggcgccggtggtggtggtggtgtcggcggcaacggcgccaccggaccctggctgttcggcgacggcggccccaccccaggcagcaccggtgccggtgcggccggtggtcacggcggcgacgcccagctgatcggcaacggcggccacggcggggccggcggcaccggggtgccgaacgggtcaggtggtgccggcggcctcagcgggctgctgttcggcgagccgggggcgaacgggtag

SEQ ID NO: 539 - DNA, 2196 bp, Mycobacterium tuberculosis H37Rv
atgtcgtttgtgatcgcgaaccccgagatgctggcagcggcggcgaccgatttggccggcatccggtcggcgatcagcgccgcgaccgcggcggccgcggccccgacgatccaggttgccgcggccggcgccgacgaggtgtcgctggccatctcggcgctgtttggccagcacgcccaggcctatcaggcgctcagcgcccaggcgacgatctttcacgaccagttcgtgcaggccctgacctccggcggcaacctgtatgcggccgccgagagccacaccgtcgagcagatggtgctcaacgcgatcaacgcgcccacccagacactgttcggccgcccgctgatcggcgacggcgccaacgggaccgcggagaacccggacggccaaaacggcggcctgctgttcggcaacggcggcaacggctttacccagacgaccgccggggtggccggcggcaacggcggcagcgcggggttgatcggcaacggcggggccggcggcggcggcggggccggcgccgccggcggcctcggcggcaacggcgggtggctgtacggcaacggcggggccggcggcatcgggggcgcgggcaccggaaccggtggtcacggcggggccggcggggccggcggccgggcctggctgtggggcaccggcggggccggcggagccggcggtgacggcggctggttgttcggcgacggcggggccggcggcaccggcggcaacggcggcagcggctttaacagcttgacctcttcggtcggcggcgccggcggggccggtgggcacgccgggctgttcggcgccggcgggaccggcgggaccggcggcatcggcgggcaaaacaccgagaccggcccggccgccagcaacggcggcgcgggcggcgccggtggcggcggcgggtacctggtcggcgatggcggcgccggcgggaccggcggggccggcgggaagaattccagcggtggcgccaccctcaccgggggcaccggagggaccggcggggccggcggggcggccgggtggctctacggcagcggcggcgccggcggtgccggcggcgccggcgggctcaacaacgccggtggtgccaccggcggcaccggcggtaccggcggagccggcggctctggagcgtggctgtacggcaacggcggggccgccggggccggcggcaacggcggcaacaataccagcgccggcaccggtggtgtcggggctagcggcgggaccggcggaaacgccgggctgatcggcgccggcggccacggcggggccggcggcgccggcggaaaccaaaccggtggcgtgggcaacggcggggccggcgggaacggcggcgccggcggggccggtggtcagctgtacggcaacggcggggacggcggcaacggcggggccggcggggccaacatcgccggcggcaatggcagcgacggcggcgccgccggccacggcggggccggcgggagcgcccggctgatcggagccggcggccacggcggggacggcggcgccggcgggaacaccgccggcagaagggccgacgcgatcgccggcaccggcggggacggcggcaacggcgggaatggcggcttgctaagcggcaacgccggggccggcggccacggcggggcgggcgggagcagcaccgcgaccaccaccaccggaacacccccaacgggtgcaacgggcggcaatggcggcaacggcggggccggcggcacggccgggtttaccggcagcggcggcatcggcggcaacggcggggccggcggcaccggcggtaacgccggtgtcgccttgtcggttggcagcacgggcggactgggcggtaacggcggcagcgggggcctcggcggcggcggcgggtcgctcttcggcaatggcggggccggcggtgtcggcgcaaccggcggaaacggcggaagcggtatcgggcccgccagcgtgggtggcaacggcggcaagggcggcgttggtgcggccggcgggcttgccgggcagatcggcaacggcggtagtggtgggtccggcggtgccgggggcaacggcgggaccggcgataccgccggcaacggtggcaatggtggtgccggcgcggtcggcggcaacgcccagctcatcggcaacggcggcaacggcggtggcggcgggaacggcggaaccggcgccgacggcacctaa

SEQ ID NO: 540 - DNA, 1065 bp, Mycobacterium tuberculosis H37Rv
atgccggggcggttcagaaacttcggtagccaaaacctgggtagcggcaacatcggcagcaccaacgtgggcagcggcaacatcggcagcaccaacgtgggcagcggcaacatcggcgacacgaacttcggtaacggaaacaacggcaacttcaactttggtagcggcaataccggcagtaacaacatcggcttcggaaacaccggcagcgggaatttcggtttcggaaacacgggcaacaacaacatcggtatcgggctcaccggcgatggtcagatcggcatcggcggactgaactcgggcagcggaaacatcggtttcgggaactccggcaccggaaacgtcggtttgttcaactccggcaccggcaacgtaggcttcgggaactccggtactgcgaacactggattcgggaacgcgggcaacgtcaacaccggattttggaacggcggcagcacaaacactggcctcgctaacgccggcgccggcaacacaggctttttcgacgctggcaactacaacttcggcagtcttaacgccggaaacataaactcgagttttgggaattcgggtgacggcaacagtggtttcctcaatgctggcgacgtcaactccggtgtgggcaatgcgggtgatgtcaacactggcttagggaactcgggcaacatcaatactggtgggtttaatccgggcacgctcaacacgggcttcttcagcgcgatgacccaagctggtccgaattcgggcttcttcaacgccggtaccggtaactctggtttcgggcacaacgacccggctggcagtggcaactcgggcattcagaactcgggcttcggcaactcgggctatgtcaataccagcaccacaagcatgttcggcggtaactcaggggtgctcaacacgggctacggcaactcaggtttctataacgcggccgtcaacaacaccgggatttttgtgaccggcgtgatgagttcgggatttttcaattttgggacgggcaactcgggcctgctggtcagcggcaatgggctttcgggtttcttcaagaacttgttcggatag

SEQ ID NO: 541 - DNA, 2352 bp, Mycobacterium tuberculosis H37Rv
atgtcgttcgtgctggcgatgccggaggtgttggggtcggcggcaacggatctggccgctctgggctcggtgctgggcgcggccgatgcggccgcggcggctacgacgacgggcatcgtggccgcggcccaggatgaggtgtcggcggcgatcgcggcgttgttttccgcccacggccgggcctatcaggtggccagtgcgcaggcggcggcggttcacgcccagttcgtggaggcgttgagcgcgggtgcgggggcctacgccagcgcggaggccgccggcgcggcggtgctggccaacccggcgcagagcgtgcagcaggacctgctggccgccgtcaatgcgcaaagtgtcgcgctcacggggcgcccgttgatcggcaacggcgccaacggggccccgggcacgggggccaatggtgcgccgggcgggtggttgctcggtaatggtggggccggcgggtccgccgccgctggctcgggcctgcccggcggggccggcggggccgccgggttgttcggcaccggcggggctggtggggccggcgggagttccacggtaggtgatggcgaggccgggggtgccggtggatcaggtggctggttgttgggcaccggtggggtcggcggggtcggcgggctcggggccggcgccggtggggccggcggggttggtggggccggcgggctgttgggtgctggcgggcacggcggcgccggcgggctaggcgccgtcaccggtggggtcgggggaactggcggagccggtgggctgctggccgggctgctggccgggccgggcggggccggcgggaccggcggacgtggctttctcaacaacggtggggtcggtggggctggcggcaacgccgggctgctgttcggtgccggcggcaccggtggatccggcggagccggcctaggtggtgacggtggggccggtggggccggcggcaacaccggtgtgctgttcggcaacgccggatccggggggaccggcgggttcggcgataccgacgggggagccggcggtgccggcggtgacgccggctggttgggctccggtggggtcggcggggccggcgggttcggcgaaaccggtgacgggggtgtcggcggggccggcggcaaggccgggttgctgatcggtaacggcggggccggcggcgccggtgggcaaggcgccgtgaccggcggtaccggcggggccggcggcgacggggtgctgatcggcaacggcggcaacgccggcatcggcggaaccggaccgaccgcgggtgataccggcgcgggtgggatcagtgggctgctgctgggcgccgacggcttcaacaccccggccagcgcctctccgctgcacaccctgaaacaacaggcgctggccgcgatcaacgcgccgacccagacactgaccgggcgaccgctgatcggcaacggcacccccggggcggtcggcagcggggccaccggggcccccggtgggtggctgctcggcgacggcggggccggcgggtccggcgcggcgggctcgggcgcgcccggcggggcgggcggggctgccgggctgtggggtaccggcggggccggcggggccggaggcagctcggcgggtggcggcggggccggtggggccggcggggccggcggctggctgctcggcgacggcggggccggcgggatcggcggagccagcaccgtactcggcggcaccggcgggggaggcggggtcggtgggctgtggggcgccggtggggccggcggggccggtggaaccggccttgttggtggcgacggcggggccggtggggccggcgggaccggcggactgctggccgggctgatcggtgccggcggaggtcacggcgggaccggcgggctcagcactaatggcgacggcggggttggcggggccggcgggaatgccggaatgctcgccgggccgggcggcgccggcggagccggcggtgacggcgaaaacctggacaccggtggggacggcggggccggcggtagcgcagggctgctgttcggcagcggcggcgccggcggcgccggcggatttggtttcctcggtggggacggcggggccggtggcaacgccgggctgctgttgtccagcggcggggccggcgggttcggcgggttcggcaccgccggtggggtcggtggggccggcggcaatgccggctggctgggcttcggcggggccggtggcgtcggcggcagcgccgggctgatcggcaccggcggcaacggcggcaacggcggcaccggcgccaacgccggcagccccggaaccggcggcgccggcgggttgctgctgggccaaaacgggctcaacgggttgccgtag

SEQ ID NO: 542 - DNA, 2085 bp, Mycobacterium tuberculosis H37Rv
gtgtcgttggtgatcgcgacgccgcagctgctggcaactgcggctttggatttagcgagtattggttcgcaggtgagcgcggctaatgcggccgcggcgatgccgacgacggaagtggtggctgcggctgccgatgaagtgtcggcggcgattgcggggttgttcggggcccatgctcggcagtatcaggcgctcagcgtacaggtggcagcgtttcacgagcagtttgtgcaggcgttgactgcggccgcgggtcggtatgccagcactgaggccgctgttgagcggagtctgctgggtgcggtgaatgcgcccaccgaggcgcttttggggcgcccgttgatcggaaacggcgccgacgggacggcacccgggcagcctggcgcggccggcgggttgctgtttggcaacggtggcaacggcgcggctggcgggttcggtcaaaccggcggcagcggaggcgcggccgggttgatcggcaacggcggcaacggcggggccggtggtaccggcgcggccggcggtgccggtgggaacggggggtggttgtggggcaacggcggcaacggcggtgtcggcggcaccagcgtggccgcaggcatcgggggtgcgggcggtaacggcggcaacgccgggctgttcggccatggcggcgccggtggtaccggcggcgccggcctcgccggggcaaacggggtcaatcccacgcccggccccgcggccagcaccggggacagcccggcagatgtgtccggcatcggtgatcaaaccggcggcgacggcggcacgggcggccatggcactgccggcacgccgaccggtggcaccggcggcgacggtgccaccgcgacggcaggctcgggcaaggccaccggcggtgccggtggtgacggcggtaccgccgctgccggtggcggcggcggcaacggcggcgacggcggagtcgcgcagggcgacattgcgagcgcctttggcggtgatggtggcaacgggtccgacggtgtagccgccggcagtgggggtggtagcggcggcgccggaggcggcgctttcgtacacatcgccactgccacctctaccggtggtagcggcggtttcggtggtaacggggctgccagtgccgcctccggcgccgacggtggcgcagggggagctggcggcaatggtggcgccggcgggttgctattcggtgatggcggcaacggtggcgccggtggcgcgggtggtatcggtggtgacggcgccacgggggggcccgggggaagcggcggcaacgctggcatcgcgaggtttgacagcccagaccccgaggcagaacccgatgtggtcggcggcaagggtggtgatggcggcaagggcggcagcggccttggcgtcggcggcgccggcgggaccggcggcgcgggcggcaacggcggcgccggcgggttgttgttcggcaacggcggcaacggcggcaacgccggggccggcggggatggcggcgccggcgttgccggtggggttggcggtaacggcggcggtggtggcaccgcgacgtttcacgaagacccggtcgctggtgtctgggcggtcggtggcgtaggtggtgatggtggctccggcggcagctcgcttggtgtcggcggggtgggcggagccggtggcgtgggtggcaagggtggcgccagcggcatgttgatcggcaacggcggcaacggtggcagcggcggagtcggtggggccggtggagtcggcggggctggcggtgacggcggcaacggcggctccggtggcaacgccagtacttttggcgatgagaactccatcggcggggccggcgggacgggcggcaacgggggcaacggcgcaaacggcggtaacggtggcgctggcggtattgccggcggtgcgggtgggtccggagggttcctcagcggtgccgcaggagtcagcggcgctgacggtatcggtggcgcgggcggcgcaggcggtgccggtggcgcgggcggtagcggcggtgaggcaggcgcggggggcctcaccaacggccccgggtcccctggcgtttccggcaccgaaggcatggccggcgcgcccggctag

SEQ ID NO: 543 - DNA, 2514 bp, Mycobacterium tuberculosis H37Rv
atgtcgtttgtgattgcggcgccagaggttatcgcggcagcggcaacggatttagccagtctcgagtcgagcatcgccgcggccaacgcggccgcggcggccaacaccacagcactgctggccgcgggtgccgatgaagtctcgacggcggttgcggcgctgttcggcgcccacggccaggcctatcaggcgctcagcgcccaagcgcaggcgtttcatgcccagttcgtgcaggcgttgacctccggtggcggcgcgtacgccgccgccgaggccgccgccacctcgccgctgctcgccccgatcaacgagttcttcctggcgaataccgggcgcccgctgatcggcaacggcaccaacggcgcccccggcaccggggccaatggcggggacggcggctggttaatcggcaacggcggcgccggaggatccggcgcggccggcgtcaacggcggggccggcggcaacggcggcgccggcgggctcatcggcaacggcggcgccggcggcgccggcgggagggccagcacggggaccggcggcgccggcggcgccggcggggccgccggcatgctgttcggggccgccggggtcggcggtcccggcggattcgcagccgctttcggcgccaccggcggcgccggcggggccggcggaaacggcgggctgttcgccgacggcggggtcggtggcgccggcggggcaaccgacgccggcaccggcggggccggcggatccggcggaaacggcgggctgttcggcgccggcggcaccggtgggcccggcggattcggcatctttggcggcggcgccggcggggatggcggctctggcgggctgttcggcgccggcggcaccggcggtagtggcgggacgagcataatcaacgtcggcgggaacggtggggccggcggcgacgccggcatgctcagcctcggtgccgccggcggcgccggcggcagcggcggatccaacccggacggtggcggcggtgccggtgggatcggaggcgacggcggcacgttgttcggctccggcggcgccggcggcgtctgcgggctgggcttcgacgccggcggggcgggcggcgccggcggaaaggcgggtctgctcatcggggcgggcggtgccggcggcgccggcggcgggtccttcgcgggcgccggcggaaccggtggggccggcggcgcgcccgggctcgtcggcaacgccggcaacggcggcaacggcggcgccagcgcgaacggcgccggcgccgccggcggcgccggcggaagcggcgtgctgatcggcaatggcggtaacggtggtagtggcggcactggcgcacccgccggcacggccggcgccggcggcttaggcgggcagctactaggtcgagacggattcaacgcccccgccagcacgccactgcacaccctgcagcaacaaatcctcaacgcgatcaacgagcccacccaagccctcaccgggcgaccgctgatcggcaacggcgccaacggcactccggggaccggggccgacggtggggccggcgggtggttgttcggcaacggcggcaacggcggccacggagcgaccggcgccgacggcggagacggcggatccggcggggccggcggaatcctgtcaggtattggcggcaccggcgggtccggcggcatcggaacgacgggccaaggcgggaccggcgggaccggcggagccgccttgctgatcggctccggcggcaccggcggcagcggcgggtttggcctggacaccggcggggccggcgggcgcggcggtgacgccggcttgttcctcggtgccgcagggaccggcggccaggccgccctctcccaaaactttatcggtgccggcggcaccgccggagccggtggtaccggtgggctgttcgccaacggcggggccggcggggccggcgggtttggcgcgaatggcgggaccggggggaacggattgctcttcggcgccggcggcaccggcggggcgggcacgctcggcgccgacggcggcgccggggggcacggcgggctgttcggcgccggcggcactggcggtgctggcggcagcagcggcggcaccttcggcggcaacggcggcagcggcggcaacgccggcctactcgccctcggcgcctccggcggcgccggcggcagcggcggcagcgccttaaatgtcggcgggaccggcggggtcggcgggaacggcggcagtggcggctcgctcttcggcttcggcggtgccggcggcaccggtggctccagcggcatcggcagcagcggcggcaccggcggtgacggcggtacggccggggtgttcggcaacggcggcgacggcggcgccggcgggtttggcgctgacaccggtgggaattcgagctcggtccccaacgccgtgctgatcggcaacggcggcaacggcggcaacggcgggaaagccggcggcacacccggcgccggcggcaccagcgggctgatcatcggcgagaacgggctcaacggcctgtaa

SEQ ID NO: 544 - DNA, 2745 bp, Mycobacterium tuberculosis H37Rv
atgtcgtttgtgatcgcggtgccggagactatcgcggcggcggcgacggatctagccgatctcggctcgacgatcgctggggccaacgcggctgcggcggccaacacgacgagcctgctggccgccggtgccgatgagatctcggcggcaatcgctgcgttgttcggcgcgcacggccgggcctatcaggcggcgagcgccgaggcggcggcgtttcatggtcggttcgtgcaggcgctgaccaccggggggggcgcctatgcggccgccgaggccgccgccgtgacgccgctgctcaactcgatcaacgcgcccgtcctggccgctaccggccgtccgctgatcggtaacggggctaacggtgctcccggcaccggggccaacggaggggatgccggctggttgatcggcaacggtggcgccggcggatccggtgcaaagggcgccaacggcggggctggtggccctggtggggccgccgggctgttcggcaacggcggggccggcggtgccggcggaaccgccaccgccaacaacgggatcggcggggccggtggcgctggcgggtccgccatgctgtttggggccggcggcgccggcggcgccggcggggctgcgacgtctcttgtcggtggcatcggcggtaccggcggaaccggcggcaacgccggtatgctcgccggcgccgccggggccggcggtgccggcgggttcagcttcagcactgccggtggggctggcggcgccggcggggccggtgggctgttcaccaccggcggtgtcggcggcgccggtgggcagggtcacacgggcggggcgggcggcgccggcggggccggcgggttgtttggtgccggcggcatgggcggggcgggcggattcggggatcacggaacgctcggcaccggcggggccggcggggacggtgggggcggcggtttgttcggcgccggcggggacggcggggcaggcgggtcaggactgaccaccggcggcgctgccggtaacggtggtaacgccgggacgctttccctgggtgccgccggtggcgccggcggcaccggtggggctggcggcactgtcttcggtggtggtaagggcggcgccggcggagccggcggtaacgccggcatgctcttcggctccggcgggggtggcggcaccggcgggttcggcttcgccgccggcgggcagggtggggtcggcggcagcgccggcatgctcagcggctccggcggctccggcggtgctggcggctctgggggccccgcgggcaccgccgcaggtggggcgggtggggcgggtggggcgcccgggttgatcggcaacggcggcaacggcggcaacggcggcgagagtggcggcaccggtggtgtcggcggggccggtggaaatgccgtgctgatcggcaacggcggcgagggcggcatcggcgcgctcgccggcaagtccggcttcggcggcttcggcgggttgctgctgggcgccgacggatataacgctcccgagagcacctcgccatggcacaacctgcagcaggacattctcagtttcatcaacgaacccaccgaggcattgaccggacgcccgctgatcggtaacggcgacagtgggacgccgggaaccggggacgatggcggtgccggcggctggttgttcggcaacggcggcaacggcggggccggtgcggccggcaccaacggcagcgcgggcggcgccggtggggcaggcgggatcctgtttggcaccggtggcgccggcggggccggcggcgtcggaacggcgggtgccggcggggccggtggcgccggcggatccgccttcttgatcggttccggcggtaccggtggtgtcggcggggccgccaccaccaccggcggcgtcggcggggccggcgggaacgccggcttgctcatcggcgcggctgggctcggcgggtgtggcggcggcgctttcaccgcaggcgttaccactggcggcgccggcgggactggcggcgctgccgggttgttcgccaacgggggggccggcggcgccggcgggaccggcagcaccgccgggggcgccggcggggccggcggggccggcgggctgtacgcccacgggggaaccggcggaccaggtgggaacggcggctccacgggggccggagggacaggcggtgccggcgggcccggtgggctgtacggtgccggcggctctggcggggccggcggtcatgggggcatggccggcgggggtggcggtgtaggcggcaatgctggctcgctcaccctcaatgcgtcgggcggtgccggcggcagcggcggctccagcctgtcaggcaaggccggtgctggcggcgccggcggcagcgcgggattgttctacggctccggcggggccggcggcaacgggggctacagcctcaatggcactggcggtgatggcggcaccggtggggccggccaaatcaccggccttcgcagcggcttcggcggcgccggcggcgccggcggcgccagcgataccggcgccggcgggaacggcggcgccggcggcaaggccgggctgtacggcaacggcggtgacggtggcgccggcggggatggcgccaccagcggcaagggtggagccggcggcaacgccgtggtgatcggcaacggcggcaacggcggcaatgccggaaaagccgggggcacggcgggtgccggcggcgccggtgggctggtactcggccgggatgggcagcacggcttgacgtag

SEQ ID NO: 545 - DNA, 2226 bp, Mycobacterium tuberculosis H37Rv
atgtcgttggtgatcgtaaccccggagacggtggccgcggcggcctcggatgtggcgcgcatcgggtcatcgatcggtgtagccaacagcgcggcggcggggtcaaccaccagcgtgctggccgcgggcgccgatgaggtgtcggcggcgatcgcgacgctgtttggcagccatgctcgggagtatcaggcgatcagcacgcaggtggcagcgtttcatgaccgatttgcgcagacgttaagcgccgcggtcggctcgtatgtcagcgcggaggcgaccaacgccgcaccgttggcgacgctggagcacaacgtgctcaatgccctcaatgcgcccacccaggcgttgctgggtcgcccgttgatcggtgatggggcggctggagcacccggcaccgggcaggccggcggggccggcgggatcttgtggggcaacggtggggccggcggctcgggcgcgcccggccaagtcggcggggccggcggggccgccgggttgttcggcaccggcggggccggtggggccggtggggccggcgccgccggtggggccgggggtagcggcggctggctgctgggcaatggtggagtcggcggggccggcgggcagagcctgctgggcggggcaaccggcggggccggcggcaacgccggactgttcggggtcggcggaaccggcgggcccggcgggcccggcgggcccggcggggtcggcggtaccggtggtgccggtggcctgggcgggaccctctacggggccggcgggcacggaggtgccggcgggcccggcccgatcggtggtgtgggtggacacggcggtgtcgggggtgcggccgggctgttgggcgtgggcgggcacggtggtgccggcggacacggcgcggagggtgtggccggcgcagccggtgaggacttgtccccgcacggtacgtccggtggggtcggcggcgacgccggcgatggcggcaccggagggcggggcggctggctggccggcgccggtggggccggcggggccggtggggttggcgggaccggcggggccggcggggccggattttctcgtgccttgattgtcgctggggataacggcggtgatggtggtaacggcgggatgggcggggctggcggggctggcggccccggcggggccggcggcctgatcagcctgctgggcggccaaggcgccggcggggccggcgggaccggcggcgctggtggcgtcggcggtgaccgcggagccggcggccccggcaaccaggccttcaacgcaggtgccggcggggccggcggccatggcggtgaccccggcgccggcggggccggaggcaccggcggagccggctccatcaccggcgctcagggcgccatcggcgccacccccaccagcggcggcaacggcggggccggcggcaacggcgccaacgccaccaccgcgggcaccaacggcgccaacggcggacccggcggccatggcgggctggtcggcaacggcggcgccggcggcaacggcgccaacggcgccgcagggacgaacgcgagcgattcgggcgcagtcggtggcaaaggcaatagcggcggcaacggcggccagggcggcgccggcggcgacggcggaactctcgccggcaatggcggggccggtgggactggcggccgcggcgcagacggcgggctcggtggtagtggtgccgagggtgccaatgccaccaccgcgggcgagcgtggccaggacggtggtaaaggcggcaacggtggggtcggcgggaccggcggcaacgccgtcgcacccggtgccaacggcggccatggcggcaacggcggcaatcctggcttcagcggcgctggcgggctcggggggctcagcggtgacggcgtgacccgcgccgcgcagggtgcgacccccgactttgcagacaccgggggcaaaggcggcaacggcggtaacggcgccaacgccgttgcacccggcggcaccggcgccagtggcggagccggcgggaacgctggggctggcggcaagggcggggaaaacatcatcggcgatggcggcggcggaaacggcggggccggcggcaagggcggcgccggcaccctgctaggtctcacggtatttggcgacaatggcggcgccggcgtcctcggcgactcgacggacccagatggcagcggcggtgctggtggcgcgggcggcgccggtggcgccggtggcgatccaaccatctga

SEQ ID NO: 546 - DNA, 1632 bp, Mycobacterium tuberculosis H37Rv
atgtcgtttgtcacggcagctccagagatgctggcgacggcggcgcagaatgtcgcgaatatcggcacatcgctgagtgcggcaaacgcgacggcagcggcgtccacgacctcggtgctggcggccggagccgacgaggtatcgcaggctatcgcaaggctgttcagtgattacgccacgcactatcagtcgctgaacgctcaagccgcggcatttcatcacagcttcgtgcaaacgttgaacgccgccggtggcgcctattcgagcgccgaggcggccaacgcttcggcgcaggcgttggaacagaatctgttggccgtgatcaatgcgcccgcccaggcgttgttcgggcgtcccctgatcggcaatggcgcgaatggaacagcggccagccccaacggcggtgatggtgggattttgtacggcaacggcggcaacggcttctcccaaacgaccgccggggtggccggcggcgccggtggttccgcgggcctgatcggcaacggcggcaatggtggcgccggtggggccggtgctgccggcggggccggcggcgccggcggatggctgctcggcaacggtggcgccggcggtcccggcggcccaacggacgttcctgccggcacaggtggagccggcggggccggcggcgacgccccattgatcggctggggcggcaacggcgggcccggcggtttcgctgcttttggaaacggtggggccggcggcaacggcggcgccagcggttcgctctttggcgtcggcggcgccggcggcgtcggcggatcgagcgaagacgtcggcggcaccggcggggccggcggcgctggccgcggtctattccttggcctgggcggtgatggcggcgccggcggcaccagcaacaacaacggcggtgacggtggcgccggcggcaccgcgggaggtcgattgttcagcctgggcggtgacggtggcaacggtggtgccggtaccgcaatcggatccaacgccggtgacggtggcgccggcggtgacagcagcgccctgatcggctacgcccagggcggctccggcggcctcggcggcttcggcgaaagtaccggcggcgacggcggcctgggcggcgccggcgctgtgctcatcggcacgggcgtcggcggtttcggcggcctcggtggcggctccaacggcaccgggggcgcgggcggcgcgggcggcacgggcgccacgctgatcggcctgggcgccggcggcggcggcggcatcggcgggttcgccgtcaacgtgggcaacggcgtcggcggtctgggcggccagggcggccagggcgccgcgctgatcggcctgggcgccggcggtgccggcggtgccggcggcgccacagtcgttggacttggtggcaatggcggtgacggcggtgacggtggcggcctgtttagtatcggcgtcggtggggacggcggcaacgccggcaacggcgccatgcctgccaatggcggcaacggcggcaacgccggggtcattgccaacggctcctttgccccgtcgttcgtcggcttcggcggcaacggcggcaacggcgtcaatggcggcaccggcggcagcggcgggatcctttttggcgccaacggcgcgaacggaccgtcgtag

SEQ ID NO: 547 - DNA, 1821 bp, Mycobacterium tuberculosis H37Rv
atgtcgtatgtattggcgacgccggagatggtggcagcggcagcaaacaatttggcgcagatcggctcgacgttgagcgcggccaatgccgcggcgctggccccgaccaccggagtgctggccgcgggcgccgacgaggtgtcggcagcggtggcgtcgctgttttccgggcacgcccaggcctatcagacactcggcacgcaggcggccgcgtttcatgaacggtttatccaggccttgagcacggctgcgggcgcatatggtagcgccgaggccgcaaatgcctccccgctgcagcaagcgttgaatgtgatcaacgcgcccacgcagacgctgctcgggcgccccctgatcggcaacggcaccaatggtgcgccgggtaccgggcaggccggcgggccgggtggcttgttgtatggcaacggcggcaatggcgggtccggcggggtcggccaagccggcggagccggcggcagcgccgggttgatcggcatcggcgggaccgggggggccggaggggccggcgcggtcggcggcgtcggcggcaacggggggtggttatacggcaatggcggggccggcgggctcggggggaccggggtggccggcgtcaatggcggtatgggcgcagcaggaggtgccggcggcaacgcctacctgttcggttctggcggcgcgggcgggcagggcggtatgggggcagccggggcagacggcgtcaaccccacacccaccggcaccgctgatgccggcagtaccggcaccgaccagacgctgggcggcaacgccataggcggtaacggtggccccggcgatgccggcgacgcgatgacgtccggcggcgctggcgggtctggcgggaacgccgtctcaaccgtcaacggcgacgccgtgggcggtgagggaggcaaagggggtgagggcgcctatggcggcgctggcggcgccggcggcagcgccgcttccatcggcaatgcagccataggaggtaacggcggtgccggcgggaacgcccaggcccccggcggtgtggggggcgccggcggcgaaggcggggatgcccaggtgggcaccaattctcccagcaacgcggaagccggtaacggcggcagcggcggcaacggcttcgacagcttcgcttccggcggtaccggcggagcgggcggaaccgggggcgccggtggccgcggcgggctgctgatcggcgacggcggcgccggcggcgcgggcggagtcggtggtaccggtggtagcggtgcccccggcggcggcggcggcgccgggggcgacggcggtgccgccaacaccgacagcgccggcagttcacgcaaggcgttcgggggcgatggcggtgtgggcggtgacggcgcgagcgccctcggcaccggtggcgaaggcggtatcggcggccagggcggtaacgggggtgctggcgggctgctcatcggcaacggcggcgccggtggtgtcggcggcacggccggtgccggtggtactggtggttccggtggtgctggaggtgccggaggcgccggtggtggcggcaccaacagtggtccgggcgcagcgtttggcggtaacggcaacaccggcggcaacggcggcaacggcggcgcccccggcgccctcggcggcaagggcgggtccggcgggctgattggccgcgcgggcagcgacggtggcgttggtgccggaggagcgggcggcgcgggtggcgccggcggcacaggcggtgagggcggcacgggcggcgacgggaaaaccaccgacggcaatcccggcatgggcggcagcccgggcagcgccggccaacccggctaa

SEQ ID NO: 548 - DNA, 1731 bp, Mycobacterium tuberculosis H37Rv
atgtcgtttttgtttgcacagccggaaatgctgggcgcggcggcgacggatctggcaagcatcggctcggcgatcagcacggccaatgctgcggccgcggccgccacgacgcgtgtgctggccgccggtgccgatgaggtgtccgccgccgtggcggcgctgtttagcggccacgcgcagacctatcaggcgctgagaactcaggcggcggcgtttcaccagcagatcgtgcagaccctcacgagcacggcaggcgcgtatgccagcgccgaggccgccaacgtcgagcagcagctgctgggtgcgatcaacgcgccgaccatggcgctgctggggcgcccgctgatcggccacggcgccgacggggcgccggggaccgggcaggccggcggggccggcgggatcctgtacggcaacggcggcaacggcgggtccggcgccaccggtcaggccggcggtgcgggcggggcggccgggctgatcggccacggcggggccggcggcctgggtggcaccggcgcgtccggtggtgccggcggggccggcggatggctgtggggcaacggcggggccggcggcaatggcggggtcggggtggccggcgaccccggtggtgtcggcggtgccggcggtgccggcggcgccgccggattgtggggcagcggagggtccggcggcaccggcgggcaagggggggtcggtggcggcaagtccggcgacggcggcacggggggtatcggcggcgccggtggcggtggtggctggctgcacggcgacggcggcgccggcggacacggcgggcagggcggaaccggcgtcagctcaggaggcaacggcggggccggcggcaccggcggcgacggccgcggcctgtcgggcagcggcggggccggcgggcgcggcgggcaaactggggttggaggcaaagtcggggagaataacttcgggggcgcgggcggtgccggcggtaccggcgggctcatcggcaacggcggtgccggcggcaacggcgggcaaggcgcaattagcggcgccggcggggccggtggcaatgcctggctgatcggcgacggcggtgccggcggcaacggcggtgatatccgtggccagggcggcggcgccggtggagccggcggcgctggtgggcaactcattggcaacggcggcaccgggggggcaggcgggaccgtcaccagtccgaacggtcttggcggtgctggcggagccggcgggtccgccggtctgattggccacggcggcaccggcggggccggcgggcacagcgcccaggggcccgacggcaatggcggaattggtggtgccggcggggccggtggcaacggcggacaactctacggcaccggcggcaccggcggcaccggcggcaagggcggcgacggcttcggcgtgttcggcaagggcggcgccggcgggaccggcgggcgaggcggtgccgccggcctgatcggcgacgccgggaccggcgggaccggcggaaagggcggcaccgccggcgaggacggtaccggcggcaacggcgggaccggcggaaacggtggggccgccgtcctaatcggcaacggcgggggcggcggcgccggcggaaacggtggggccggcaacgatggcacccccggcaacggcgggggcggcggcgtcggcgggaccgggggaaccctgttcggccagcccggccaacccggtccgcccggccagcccggccccgcctaa

SEQ ID NO: 549 - DNA, 1920 bp, Mycobacterium tuberculosis H37Rv
gtgtggacgtcgcagatgatcgtggcgccggcgtttgtcgatgcagcggcaaaggacctagcaactattggttcggcgattagccgggccaacgccgaagcgttggtcccgataacggcgttactgcctgcgggcgctgacgacgtgtcggctgcgattgcggcgctgttcgcaacgcacgggcaggcataccaggagctcagtgcccacgcggtcgcattccatgagcagttcgtccagctcatgagcgcgggggcggcccagtacgccagcgccgaggcagccaactcgtcaccattgcaaatcgtgggccaaaccgccctcgatgccatcaattcacccgtgcagacgctgaccgggcgtccgcttatcggcaacggtgccaacggggtcgcaggaaccgggcaaaacggtggcgatggcggatggctatacggcaacggtggcaacggcgggtccggcgggacgggccaaaatggcggcaacggcgggtcggctgggctatggggtagcggcggcaatggcggccagggcggggcgggtgccaacggcgcagccggtcaacccgggaaagcgggcgggtccggcggcaacggcggcgccggtggatggatctatggtcacggtggacatggtggggccggcggaaacgggggcaacgccacagcgcccgggggtgcgtcggcaggcttcgatgggggcgccggcggaaacgggggttcgggtggtcgcggtggactgttgttcggcaacggcggcaacggctcggtcggtggcatgggaggacaaggcactaatgacacagccggagattcggccggcagcggcggattaggaggcaacgggggcaacggcgcccagggcgggtggctgatcggcaacggggggcaaggtggggacagcggcgccggcggcggcaccgactccactcaaacgggcgtcatgaacggcgcttccggcggttcggccgggatagccggtaacggcggtgacgcgggcctagtcggcaacggcggggccggtggcaacggcgggaatggagcggccgggtctgcgctgggtactaccatcttcggcgggagcggcggggtcggtggctcaggcggcgacggcggcaacggcgggtggttgttcggcagcggcgcgtccggcggcaacgggggtcagggcggtgacgcaggcaccaacggatttgcgggctttggcggctctgctggcggtggcggctgggtaggtgccgttaacttcggaccgattagtgtccagggttttgggttgtttggtcacggcggtgacggtggcaacggtggtgacgttggggccggcagcctcagcattcaatttggtgcatcagggggtgacggcggccaaggtggggtgctatacggcaatggcggcaacggtggtaacgccggcagcggcggaggtaccggcttcgaaggcagcgccggccagggtggcgccgccattctgatcggcaacggcggggccggagggaatggggcgaccggtgggaccggagtaggcaacattattcaggaagccggaggtgacggcagcgacggtggcgcgggcggcagcggaggcctactgttcggtagcggcggggccggcggcatcggcggggccggcggcgtcggcgggtcgggcaacgacggcggcaacggcggcgatggtggccaaggcggggcaagcggcctggggatcggcaacggcggacccgggggaagtggcggtaccggtggggccggcggaaccggcggcagtgcgggcactggcggtgccggcggtgacggtggtaacgccgccctgctgatcggtaccggtggcgacggcggagatggtgtcccacccgcacccgggggccaaggcggcaagggcggattgatcggtttgcctgggcagaacgggcagccgtag

SEQ ID NO: 550 - DNA, 2406 bp, Mycobacterium tuberculosis H37Rv
atgtcatgggtgatggtttcgccggagctggtggtggcggcggcagcggatttggcggggatcgggtcggcgattagctcggctaatgcggcggcggccgtcaacacgacgggattgttgaccgcgggtgccgatgaggtgtcgacagcgattgcggcgttgttcggtgcccaaggccaggcctaccaggcggcgagcgcacaggcggcggcgttttacgcccagttcgtgcaggccctgagcgccggcggaggcgcgtatgcggccgccgaggccgccgccgtgtcgccgctgctggccccgatcaacgcgcaattcgtggcggccaccgggcgcccgctgatcggcaacggcgccaacggcgcccccgggaccggagccaacggcgggcccggcgggtggttgatcggcaacggcggcgccggcgggtctggcgcccccggcgctggggccggcggtaacggcggggccggcgggctgttcggcagcggcggggccggcggggcctccaccgacgtcgccggcggggccggtggggccggcggggccggcggaaacgccggcatgctgttcggcgccgccggggtcggcggcgtcggcggattctcgaacggcggtgccaccggcggggcaggcggggccggcggggcgggcgggctgtttggcgccggaagggaacgcggcagcggcgggtcgggcaacctcactggcggggccggcggggccggcggcaacgccgggacactcgccactggtgatggcggggccggcgggaccggcggcgctagtcgcagcggcggattcggcggggccggcggagccggcggcgacgccggcatgttcttcggctccggcggctccggcggcgccggcggcattagtaaaagcgtcggggacagcgccgccggcggggccggcggggcccccgggctgatcggcaacggcggcaacggcggcaacggcggcgcgagcaccggcggcggggacggtgggcccggcggggccggcggcaccggcgtgttgatcggcaacggcggcaacggcggcagcggcgggaccggcgcgaccctgggcaaggccggcatcggcggtaccgggggggtgctgttgggcctggacggctttacggcccccgccagcacctcgcccctgcacaccctgcagcaggacgtgatcaatatggtgaacgaccccttccagacgctcaccgggcgtccgctgatcggcaacggcgccaacggcactccggggaccggggctgacggcggagccggcggctggttgttcggcaacggcggaaacggcgggcagggaacgatcggcggcgtcaacggcggggccggcggggccggcggggccggcgggatcttgttcggcaccggcggcaccgggggcagcggcgggcccggcgccaccggcctcggcgggattggcggggccggcggagccgccttgctcttcggctccggcggggccggcggaagcggtggtgccggcgcggtcggtggcaatggcggggccggcggcaacgccggtgcgctcttgggcgccgccggggccggcggggccggtggtgccggcgcggtcggtggcaatggcggggccggcggtaacggcgggctgttcgccaacgggggagccggcgggcccggtgggtttggcagccccgctggggctggcgggatcggcggggcaggtgggaacggcgggctgttcggcgccggcgggaccggcggggccggcgggggaagcaccctcgccggcggcgccggcggggcgggcggcaacggcgggctgttcggcgccggcggcaccggcggcgccggcagccatagcaccgccgccggagtttccggaggggccggcggggccggcggcgacgccggcttgctctccctcggcgcctccggcggggccggcggcagcggcggttccagcctgaccgccgccggcgtggtcggcggcatcggcggcgccggaggcttgctcttcggctccggcggcgccggcgggagcggcgggttcagcaactctggcaacggcggcgccggcggggccggcggcgacgcgggtttgctcgtcggctccggcggggccggcggggccggcgcctccgccaccggcgccgccaccggcggggacggcggggccggcggcaagtccggagcgttcggtctcggaggtgacggcggcgccggcggcgccaccggtttgtccggtgctttccacatcggcggcaagggcggcgtcggcggcagcgccgtgctgatcggcaacggcggcaacggcggcaacggcggtaacagcggtaacgccgggaaatccgggggtgcacccggccccagcggcgccggcggcgccggcgggctgctgctcggtgagaacgggctgaacggcttgatgtag

SEQ ID NO: 551 - DNA, 1305 bp, Mycobacterium tuberculosis H37Rv
ggccagagctatcaagcggtcagcgcccaggcggcggcgtttcatgaccggttcgtccaactgcttaacgccggtggaggttcatatgcgagcgccgagattgccaacgcgcagcagaacctgctgaacgcggtgaacgcgcccacccagacgctgctggggcgtccgctggtcggcgacggcgccgacggggccagtggtccggtgggacagcccggcggggacggcggcatcttgtggggcaacggcggcaacggtggcgacagcacgagccccggggttgccgggggagccggcgggtcagcggggctgatcggcaacggcggcaggggcggcaacggtgcgcccggcggtgcaggaggcaatggcggcctgggcggattgctgctgggcaacgggggtgccgggggagtcggcggtaccggtgacaacggtgtgggagacctcggtgctggcggcgggggaggcgatggcggtttgggtggacgggcggggctgatcggtcacggcggtgccggcggaaacggtggggacggtgggcacggcgggagcggcaaggccggcggcagtggcggcagtggcggcttcggccagttcggtggcgccggcgggctgctgtacggcaatggaggggcggccggttccggcggcaacggtggcgatgcaggtaccggcgtctccagcgacggtttcgccgggttgggcggcagcggtggccggggcggcgacgcggggctgattggtgtcggcggcggcggcggcggcaacggcggcgacccagggctcggtgcgcgcctgttccaggtaggtagtcgcggcggcgacggtggggtcggcgggtggctgtacggcgatggcggcggcggcggcgacggcggtaatggggggctgccatttattggctccaccaacgccggcaacggcggcagcgcgcggctcatcggcaacggtggtgccggcggtagcggcgggagcggcgcgcctggctcggtcagcagcggtggcgtcgggggcgcgggcaaccccggcggcagcggtggcaacggcggcgtgtggtacggcaacggtggcgccggcggggccgccggccaaggggggcccggcatgaacaccacctcgcccggcgggccgggcggtgtcggcgggcacggcggcaccgccatcttgttcggcgacggtggcgccggtggggctggcgccgccggcggacccggtactccggacggggccgcggggcccggcggcagcggcggcaccggcgggctgctgttcggagtccccggcccgtccggcccggacgggtaa

SEQ ID NO: 552 - DNA, 1659 bp, Mycobacterium tuberculosis H37Rv
atggctcatttttcggtgttgccgccggagatcaactcgttgcggatgtacctgggtgccggttcggcgccgatgcttcaggcggcggcggcctgggacgggctggccgcggagttgggaaccgccgcgtcgtcgttctcctcggtgaccacggggttaaccgggcaggcgtggcagggcccggcgtcggcggcgatggccgccgcggcggcgccgtatgcgggctttttgaccacagcctcggctcaagcccagctggctgccgggcaggctaaggcggtggccagcgtgttcgaggccgccaaggccgcgatcgtgcctccggccgcggtggcggccaaccgtgaggcgttcttggcgttgattcggtcgaattggctggggctcaacgcgccgtggatcgccgccgttgaaagcctttacgaggaatactgggccgctgatgtggcggcgatgaccggctatcacgccggggcctcgcaggccgccgcgcagttgccgttgccggccggcctgcaacagttcctcaacaccctgcccaatctgggcatcggcaaccagggcaacgccaacctcggcggcggcaacaccggcagcggcaacatcggcaacggaaacaaaggcagctccaacctcggcggcggcaacatcggcaataacaacatcggcagcggcaaccgaggcagcgacaacttcggcgccggcaacgtcggcaccggaaacatcggcttcggcaaccagggccccatagacgttaacctcttggcgacgccgggccagaacaacgtgggcctgggcaacatcggcaacaacaacatgggcttcggcaacaccggcgacgccaacaccggcggcggcaacaccggcaacggcaacatcggtggcggcaacaccggcaacaacaacttcggcttcggcaacaccggcaacaacaacatcggaatcgggctcaccggcaacaatcagatgggcatcaacctggccgggctgctgaactccggcagcggcaatatcggcatcggcaactccggcaccaacaacatcggcttgttcaactccggcagcggcaacatcggcgtcttcaacaccggagccaataccctggtgcctggcgacctcaacaacctgggcgtcgggaattccggcaacgccaacatcggcttcgggaacgcgggcgttctcaacaccggcttcgggaacgcgagcatcctcaacaccggcttggggaacgcgggtgaattaaacaccggcttcggaaacgcgggcttcgtcaacacggggtttgacaactccggcaacgtcaacaccggcaatgggaactcgggcaacatcaacaccggctcgtggaatgcgggcaatgtgaacaccggtttcgggatcattaccgacagcggcctgaccaactcgggcttcggcaacaccggcaccgacgtctcgggcttcttcaacacccccaccggccccttagccgtcgacgtctccgggttcttcaacacggccagcgggggcactgtcatcaacggccagacctcgggcattggcaacatcggcgtcccgggcaccctctttggctccgtccggagcggcttgaacacgggcctgtttaacatgggcaccgccatatcggggttgttcaacctgcgccagctgttggggtag

SEQ ID NO: 553 - DNA, 1086 bp, Mycobacterium tuberculosis H37Rv
atgtcgttcctgattgcttcgccggaggcgctagcggcgacagccacatatttgacaggtatcggttcggcaatcagcgcggcgaacgcggtcgcggccgccccgacaacagagatcctggcggcggggaccgacgaggtgtccaccgccatctcagcgctgttcggcgctcatgcccaggcatatcaggcgctcagcgcccacgtggcggcatttcacgaccagttcgtgcataccttgaccgccggtgccggctcatacatggccgccgaggccgccgccgcctcgcctctgcaggctttgcagctggagctgctcaacgccatcaatgcacccaccctggcgctgttgggacgcccgttgatcggcgacggcaccgatgcggcgccggggagcgggggggccggcggggccggcggcatcttgatcggcaacggcgggaccggcggcgccagcgacttagccgggaccggccgcggcggggtcggcggggcgggcggcgccggcgggctcttcggcatcggcggcgccggcgggggctgcgggtccgcggtggcgatcgggggtgacggcggggctggtggcgccggcggcgtgttcagcggcggcggcgccggcggggccggcgacgccatcgggggtagcggcggcgcgggcggcaccggtgggctgttgggtggtggcggcggcgcgggcggcgccggcggcgccggcggcaatggcgggggcgccagcaacagcgcaagtatcgggggtgacggtgggtccggcggcgcgggcggcatgctctacggtgccggcggcgtcggcggcaacggcggggccgcggtcgctatcgggggtgacggcggggccggcggcagggccggagcgatcggcaacggcggtgacggcggcaacggcgggacttccaacacccccggcggtagcggcggcgacggcggcaatggcgggaacgccggactgatcggcaacggcggtaacggcggcaacgccgagattgtcatctccggcggtagcgtcgccggcaccggtggcaacggcgggttgctgttgggcttcaacggcacgaacgggctgccgtag

SEQ ID NO: 554 - DNA, 7023 bp, Rickettsia prowazekii strain Madrid E
atgaaaaaatcaaaaattttaagaaaatttttagcaacagcctcactatgtgggacattattcactaactctaatgcaacaggaacaattattcctaataatggtagcgtaagcttgaatactgacgcaggtcttgtaggaggagtatttaacaatggcgatattatccaaatagttaatggagggcgtgaaattaaaatatcggcagataaagcaaatgctatcattggaggaatcaatacattaaaagaactgcctgattttggtggtgttgaagtaagtcaaaacgtctcaataggccctcttaatgcaggagaagatcttaatactaattttggccctcttaaatttattagtaataatgttacgtcaattattacaggagtcggtactaaaacatttagtaatatcgattttgctggtaaaaatgctactttacaaattaataaagatttaaatattacaactaaaatagataatacagtagccggaaataatggttcaataacatttgaaggtagcggtattatatcaaatcacataggctacactaactctcttttaggaataaatgtaggaaacggagaagccaagatttatgccccagaagcaaataatattacaattaatgctaaaaatataaatcttactcacaataactctatacttactctttgtgacggtaacataactacattaaagggtaatataaataatactacagaaattgacggtcaaggtatattaaatctagcttatgatcttggtagtagtagcataataacaggtgatataggtaatataggctcattagatacaataaatgttttacttggatctgcaacatttaattctacaatattaaaagcgactaatattaatttaaaacataatacttcaacactcaatttagatgataacataattgttattggtaatataaaaggtaataataacaaagatatattaaattttaaagtgcatggtactaatttagataacgaaatgattattcctgctcctcaaaaaactcatggtacattaaattttaaaggaaatgctacacttaatgggaatataaataatttaaatatacttaagtttagtggaggtcacggtaaaactttgaatttacaaggtaatactaaagtagataatcttgtttttgcagatagtgttttagattcaggtactataagtgttaacgggttgttagatacagactgtgtgacatttaacaatagtaatgttaacggcggaacattaataataaatgccaagaacacaatcagtgcaaaattattaaatgctacaaaagcaaaaatacaaatcaatgctaatttaacgatgaatcatccaagtgctggggatataagtgatattagaatagcggataatacaatctatacaatagatgcaaaaaatgggaatgtaaatttgctaaataacaacgcaaagatcatatttgaaggagctgattctatgttagctttaatcaatactggtgttacagctgatagaacctttaccatatataataatttaaatcaatctggcaatgatgaatatggaatagtaaaaatagaagcaattaaaaaagtaataactatagcaaatcaaagtggaccttatactatagggcaggataatacacatcgtcttaaggaattaatagtagagggagcaggtgatatcataatagatgatacgatatttacgaagttacttagtataaacagtacaggacaaataacatttaatcgtactttagatttaggtgcaggtggtaatattgcatttggaaagcatggtacattagtagtaaacggtgtcactggttcaattacaacttctgaaaataatcaaggaatattaacaatcaatagcgggaatattactggtgttattggcactaatgaactcggcttaaaacttgtcaatattggtgcagatcctgttacgtgctcagcaaatgtatttgcatcggtagctttaactaacccaagttctgtgttaattttagcagatggtgttacgctaactggtgaagtaacaacacataataatacaaaaggtgtattatcacttggaacaggaagtaatataacaggtcaaatcggtactaatagcgcagctcttgagaaaataaatattggggctggagctagtaatattgacagtaatatatatgcaggttctacagtactcacagatcaaacatcggaattaactttaaacaatgatgtagtcgttaacagtaatatcataactactgccgggaacaatagcggaaagttaatatttacaggtaatggcggcataacaggaaacataggagcaaatggtgcagctttacaagaggttgtatttaacggtactactaatataggtggtacagcgaactcacagaactttactgttgcacattctgcagcaaatgtggtgattacaggacttactactggtgcattaaaatacaaagatactggtacaattatagctcatggaggattggtaggagacatcgattttaataataaagctggtaaattcattttaggcgatggtgctatgattgatggatcagtgttatgtaatggaggggttgctggtacattggattttataggtgacggtaatgtaactcaaaatataggcgcagataatgcaaatagtatttcgactatcaacattcaaggcgataatacaaaaaacgtaactatagcaaatgatatatttgtagataatattcattttacaaacggtgggatattacagcttggcggaaatctcacaacgcataatattgatttcggagcaaatggtggtactttagaatttaatggtaataatacatataacttaaatgctattattgtaaacggacaaaacggtatattaaatgctttcacaaacttaaaggctagcgatgatactattggtacggttaaaataattaatataggacaaataggaacaccgcaaaactttactattcaagttaataacaaaaatttaactctagtaagtagcgtaaatagtagcattaattttggtgatgctaattcgcaattaatattatctgcaccagtagatcaaactattaaatttattaataatttaaacgaaactggaggtggtattatcactttagatagtaatggtaataatttaaccataagtggtaataatggaataaagcttggtagtaaaggtaatgagttatctagcttaaatattaaaggaaaagttactgtaactaatgatttagatatacaaaatattcatcaattaaatataaacaatggtgcattatttgatgaccaaagtctcacatctgctaaaatcaaaaatataaatattggtacagtagcaggcggagctacttatactttagatgctataaatgataattttgatttaaatactagtggtatggtatttaaacatcaagattcaatattagaactgaaaaatagttcaaatactaatgaccacactataacattaacatctgctttagatccaggtaataatcaatttggtataattaaactcataacagatactaataaattaactatagacaataatggcaatgtggcttatacactcggtacagcaaatcatatgttgaagcaattaacttttgctagtatagataatggggctatagctttaaaagtagggatcaatgttgaaaatgttaccttaaatattaaggatatagagttaaatgaggtgaatgcaaatgttctgtttaacaaaaacacaacatataccgcaacaggtaatataaacggtcatgtagatttccaaggtaatgcaggtgtaataaatcttaatgatgatatagaaattgacggtagtgttacaagtaccggtaatgtaaacggtacattaaatttcaatggatcaggtaaagtgactggtttaatcaataacatagtaatgctgcaagcaggagcaggtgatgtatcactatctgctagcggtaattattctattactgaaattcaaggtaacggtaataataatttgacatttgctgctaattcacacttaacaactgatattaataagacaggcggtcaggatttaaatttagtattcataaatggtggtagcgttagcggttctatcggcgcaaatgcagcagttggtgatattattataaacgcaggaagtgtaaatttcagtaatactcttaaaagcggtaatattgttatatcggatggtgccacgatgcaagttaataataacgtaactgctactgatatctcaggcaaaaatgcaaataacggaactttaaaactaaataatcatacacctattaatatcactagtacacttggtaataataatgctatagggaccatagaagtcgcaaataatgatgttaccattacagggacattacaagcgcaaaatattcatttttcaaatgccactcaggcagctaccttaactttaggcgcagcatcgcaagtgactaatattactacggcaggaaataatattcatactttagaagtaacagattttgatactggtaatgacggcataataggagatgcaaataatagattaaaatcaatagaattgacaggcaatggcacagtgactattaattctccacatgtttattcatctattactactgcaaataacgcgcaaggtaacgtaaaactcaatatagaaggcggtattacttatgatttaggaagtaaaataaaaagtttagcaaatgtacaaattagtgaggatactactattagaggtgatgtgtattctaaatatcttaatatagacgcaggtaaaactataaattttgatagaggtgataataacatgaatcccaaaaatttagatataccagatgctctaatagatttagatgtattaccacgctcgctctcactatttaattacttcactgatattaaagcggataatttaaattttgcagatgatactgctacagcaaattttaaagatgctgttgtaatagatgcacatattgataatggtggcattttaaaatttaatgacaatgcttggttaacacaagaaattaaaaatgctaacatcatagaaattgcatctgataaatttatgttgcttcagaaaaacattaaagcagctactttaatagctgataatgcaaatttagtattattagataatgtggaagtaaatactaatctaaatgttagagatattgtattagatttagctaattatgaattaaaatatactggtaatgttacacataatggattactgactattatcacttattttgatactgcattacaaaaaggtgggcatatattagttagtcaaggatctaatgtcgatatgtccgatttagataatttaataattaaaattaaagcacactccgatatcactaacattacctcagatactaaacaccaaatagtaaaactcgaaacaggtgcaatatatactccagtaccgcaaactaaagtcattattgatgcaagcgaggaacaaaataaatttgtgaaatgggtcgctgatgcaaacggtttggtattacttactgatactggaggtcgagacgatactggaggtcgagacgatactaggggtcgaggcaatactgacaatggctgtcgtgataattgtgatgtagggaatatcagcaataacagtagtaatgaagcaggtgggtcaagtagcgataaaaattatggcatcactgatgttgtaccaatttttgatccatctcctatcttagattatactaaaaataattatgtagcttctggtatagcaaaccaacttattaatcatgttaaagattttggtaatactactgatgcaggtaaattattaaatgatttaggttttatgtctccgaatagagttactgaaacattagatagacttagtaatagaataaatgttaatggacttaatgaaggagtagtaggactgaacggtatcgaggttgagaattttttaacagatatagcaataaatatggataatttcactgctaaagagattggcaataggttagaagaattaagcgatgcaaatactgtaaatggtctcaacaaaacaaacacattgcttaataataagattaatctaaaaagactgaatactaataatcaggcaataattgctgcaggtgatgaagataatatagtaacgggcatttggggcatgtcattttatggtaaaataaagcaaaactctaaaaacagtgcaagcggttatcaatctaatacaggtggtggtataataggctttgattataatattgataattctatagttataggggcggcttatactatggctgatagtaaagtcaagcacaaaaatgataaaaatggtgatagaaccaaagctaaaagtaatatatattctatctatgggctttataattggcttactaataacttttttgttgaagctataggtgtgtatggtagaaataaaatcaaaaattatgaaaaacgtataactactattactgatcaaatcgcaataggtaaatttattaatactttttatagctatgaattactaggtggctataactatctaatatcgcatcgtaccactataacgccaatgtttggtatgcgttatgctacatttaaaaataatggttacaaagaaaataatactactttccaaaatttatctataaagaaaaattactatgataaatttgaaactatattaggtttaaatagtgtaactcattatttatcacaagatataataataaagcccgaattacattggtttataaattatcaatgtaaaaataagttaccaaatattgatgcacgccttgacggtatagatgaaccattgacaacaattagatttaaacctgcaaagataacatataatttaggcggtggtatttctactaaaaataatatgatagaatttggtattagatataacttatctcttgcgaagaaatatacagcacatcaaggatccttaaagattaaagtgaacctgtaa

SEQ ID NO: 555 - DNA, 4932 bp, Rickettsia prowazekii strain Madrid E
atggctcaaaaaccaaattttctaaaaaaaataatttccgcaggattggtaactgcttccacggctactatagtagctggtttctctggtgtagcaatgggtgctgctatgcaatataataggacaacaaatgcagcagctacaacctttgatggtataggctttgatcaagctgctggtgctaatattcctgtcgctccaaattcagttattactgctaatgctaataatcctattacttttaatactccaaacggtcatttaaatagtttatttttggatactgcaaatgatttagcagtaacaattaatgaggatactaccttaggatttataacaaatattgctcagcaggctaagttctttaattttactgttgctgctggtaaaattcttaacataacagggcagggtattactgttcaagaagcttctaatacaataaatgctcaaaatgctcttacaaaagtgcatggtggcgctgctattaacgctaatgatcttagcgggctaggatcaataacctttgctgctgcgccttctgtattagaatttaatttaataaatcctacaactcaagaagctcctcttacacttggtgctaattctaaaatagttaatggtggtaatgggacattaaatattactaatggatttattcaggtttcagataacacttttgctggtattaagaccattaatatcgatgattgtcaaggtttaatgtttaattctactcctgatgccgctaatactttaaatttacaagtaggtggtaatactattaattttaatggaatagacggtactggtaaattagtattagtcagtaagaatggtgctgctaccgaatttaatgttacaggaactttaggtggtaatctaaaaggtattattgaattgaacactgcagcagtagctggtaaacttatctctcaaggaggtgctgctaatgcagtaataggtacagataatggagcaggtagagctgcaggatttattgttagtgttgataatggtaatgcagcaacaatttctggacaagtttatgctaaaaacatggtgatacaaagtgctaatgcaggtggacaagtcacttttgaacacatagttgatgttggtttaggcggtaccaccaactttaaaactgcagattctaaagttataataacagaaaactcaaactttggttctactaattttggtaatcttgacacacagattgtagtccctgatactaagattcttaaaggtaacttcataggtgatgtaaaaaataacggtaatactgcaggtgtgattacttttaatgctaatggtgctttagtaagtgctagtactgatccaaatattgcagtaacaaatattaatgcaattgaagcagaaggggccggggttgtagaattatcaggaatacatattgcagaattacgtttagggaatggtggctctatctttaaacttgctgatggcacagtaattaatggtccagttaaccaaaatgctcttatgaataataatgctcttgcagctggttctattcagttagatgggagtgctataattaccggtgatataggtaacggtggtgttaatgctgcgttacaacacattactttagctaacgatgcttcaaaaatattagcactcgatggcgcaaatattatcggggctaatgttggtggtgcaattcattttcaagctaacggtggtactattaaattaacaaatactcaaaataatattgtagttaattttgatttagatataactactgataaaacaggtgttgttgatgcaagtagtttaacaaataatcaaactttaactattaatggtagtatcggtactgttgtagctaatactaaaacacttgcacaattaaacatcgggtcaagtaaaacaatattaaatgctggcgatgtcgctattaacgagttagttatagaaaataatggttcagtacaacttaatcacaatacttacttaataacaaaaactatcaatgctgcaaaccaaggtcaaataatcgttgccgctgatcctcttaatactaatactactcttgctgatggtacaaatttaggtagtgcagaaaatccactttctactattcattttgccactaaagctgctaatgctgactctatattaaatgtaggtaaaggagtaaatttatatgctaataatattactactaacgatgctaatgtaggttctttacactttaggtctggtggtacaagtatagtaagtggtacagttggtggacagcaaggtcataagcttaataatttaatattagataatggtactactgttaagtttttaggtgatacaacatttaatggtggtactaaaattgaaggtaaatccatcttgcaaattagcaataattatactactgatcatgttgaatctgctgataatactggtacattagaatttgttaacactgatcctataaccgtaacattaaataaacaaggtgcttattttggtgttttaaaacaagtaattatttctggtccaggtaacatagtatttaatgagataggtaatgtaggaattgtacatggtatagcagctaattcaatttcttttgaaaatgcaagtttaggtacatctttattcttacctagtggtactccattagatgttttaacaattaaaagtaccgtaggtaatggtacagtagataattttaatgctcctattgtagttgtatcaggtattgatagtatgatcaataacggtcaaatcatcggtgataaaaagaatattatagctctatcgcttggaagtgataacagtattactgttaatgctaatacattatattcaggtatcagaactacaaaaaataatcaaggtactgtgacacttagtggtggtatgcctaataatcctggtacaatttatggtttaggtttagagaatggtagtccaaagttaaaacaagtgacatttactacagattataacaacttaggtagtattattgcaaataatgtaacaattaatgattatgtaactcttactacaggaggtatagcagggacagattttgacgctaaaattactcttggaagtgttaacggtaacgctaacgtaaggtttgttgatagtacattttctgatcctagaagtatgattgttgctactcaagctaataagggtactgtaacttatttaggtaatgcattagttagtaatatcggtagtttagatactcctgtagcttctgttagatttacaggtaatgatagtggggcaggattacaaggcaatatttattcacaaaatatagattttggtacttataatttaactattctaaattctaatgtcattttaggtggtggtactactgctattaatggtgaaatcgatcttctgacaaataatttaatatttgcaaatggtacttcaacatggggtgataatacttctattagtacaacgttaaatgtatcaagcggtaatataggtcaagtagtcattgccgaagatgctcaagttaacgcaacaactacaggaactacaaccattaaaatacaagataatgctaatgcaaatttcagtggcacacaagcttatactttaattcaaggtggtgctagatttaatggtactttaggagctcctaactttgctgtaacaggaagtaatattttcgtaaaatatgaactaatacgtgattctaaccaggattatgtattaacacgtactaacgatgtattaaacgtagttacaacagctgttggaaatagtgcaattgcaaatgcacctggtgtaagtcagaacatttctagatgcttagaatcaacaaatacagcagcttataataatatgcttttagctaaagatccttctgatgttgcaacatttgtaggagctattgctacagatacaagtgcggctgtaactacagtaaacttaaatgatacacaaaaaactcaagatctacttagtaataggctaggtacacttagatatctaagtaatgctgaaacttctgatgttgctggatctgcaacaggtgcagtgtcttcaggtgatgaagcggaagtatcttatggtgtatgggctaaacctttctataacattgcagaacaagacaaaaaaggtggtatagctggttataaagcaaaaactactggggttgtagttggtttagatactctcgctagcgataacctaatgattggggcagctattgggatcactaaaactgatataaaacaccaagattataagaaaggtgataaaactgatattaatggtttatcattctctctatatggttcccaacagcttgttaagaatttctttgctcaaggtaatgcaatctttaccttaaacaaagtcaaaagtaaaagtcagcgttacttcttcgagtctaatggtaagatgagcaagcaaattgctgctggtaattacgataacatgacatttggtggtaatttaatatttggttatgattataatgcaatgccaaatgtattagtaactccaatggcaggacttagctacttaaaatcttctaatgaaaattataaagaaaccggtacaacagttgcaaataagcgcattaatagcaaatttagtgatagagtcgatttaatagtaggggctaaagtagctggtagtactgtgaatataactgatattgtgatatatccggaaattcattcttttgtggtgcacaaagtaaatggtaaattatctaactctcagtctatgttagatggacaaactgctccatttatcagtcaacctgatagaactgctaaaacgtcttataatataggcttaagtgcaaacataaaatctgatgctaagatggagtatggtatcggttatgattttaattctgcaagtaaatatactgcacatcaaggtactttaaaagtacgtgtaaacttctaa

SEQ ID NO: 556 - DNA, 6318 bp, Porphyromonas gingivalis W83
atggcacgaattatcttggaggctcacgatgtatgggaagacggcacaggctatcaaatgctctgggatgcagatcacaatcagtacggcgcatccattcccgaagaatctttttggtttgccaacggaacgatcccggccggtctttacgatcctttcgagtataaagttccggtcaatgccgatgcatctttttctcccacgaatttcgtgcttgatggaacagcatcagccgatattcctgccggcacttatgactatgtaatcattaaccccaatcctggcataatatatatagtaggagagggtgtctccaaaggtaacgattatgtggtagaggccggtaagacttatcatttcactgtccaacgacaaggccccggcgatgctgcgtccgttgtagtgaccggagaaggtggcaatgaattcgctcccgtacagaatctccaatggtctgtatccgggcagacagtgaccctcacttggcaagcccccgcatccgacaaacggacttatgtgttgaacgaaagcttcgatacgcaaacgcttcctaacggctggacaatgatcgatgctgatggtgatggtcacaattggctatctacaataaacgtttacaacactgctactcatacaggtgacggtgctatgtttagcaaatcatggacagctagcagtggtgcaaaaattgatttgagtcctgacaactatttggtaactcctaagtttacggttcctgagaatggtaaactttcttattgggtttcatctcaagagccttggactaatgagcattatggagtgttcttgtccacaaccggaaacgaggctgcaaactttacgataaagctgctggaagaaaccctcggatccggcaaacctgctccgatgaacttggtgaagagtgaaggagtaaaggctccggcaccttatcaggaaagaaccatcgatctctctgcctatgccggacaacaggtgtacttggcattccgtcatttcggctgtacaggtatattccgtctttatcttgatgacgtggctgtttctggtgaaggttcttccaacgactacacgtacacggtatatcgtgacaatgttgttatcgcccagaatctcacggcaacgacattcaatcaggaaaatgtagctcccggccagtacaactactgtgttgaagttaagtacacagccggcgtatctccgaaggtatgtaaagacgttacggtagaaggatccaatgaatttgctcctgtacagaacctgaccggtagtgcagtcggccagaaagtaacgctcaagtgggatgcacctaatggtaccccgaatccgaatccgggaacaacaacactttccgaatcattcgaaaatggtattcctgcctcatggaagacgatcgatgcagacggtgacggcaacaattggacgacgacccctcctcccggaggctcctcttttgcaggtcacaacagtgcaatctgtgtctcttcggcttcttatatcaactttgaaggccctcagaaccctgataactatctggttacaccggagctttctcttcctaacggaggaacgcttactttctgggtatgtgcacaagatgccaattatgcatcagagcactatgccgtgtatgcatcttctacgggtaacgacgcttccaacttcgccaacgctttgttggaagaagtgctgacggccaagacagttgttacggcaccggaagccattcgtggcactcgtgttcagggcacctggtatcaaaagacggtacagttgcctgcgggtactaagtatgttgccttccgtcacttcggctgtacggacttcttctggatcaacctcgatgatgttgagatcaaggccaacggcaagcgcgcagacttcacggaaacgttcgagtcttctactcatggagaggcaccagcggaatggactactatcgatgccgatggcgatggtcagggttggctctgtctgtcttccggacaattgggatggctgacagctcatggcggcaccaacgtagtagcctctttctcatggaatggaatggctttgaatcctgataactatctcatctcaaaggatgttacaggcgcaacgaaggtaaagtactactatgcagtcaacgacggttttcccggggatcactatgcggtgatgatctccaagacgggcacgaacgccggagacttcacggtcgttttcgaagaaacgcctaacggaataaataagggcggagcaagattcggtctttccacggaagccaatggcgccaaacctcaaagtgtatggatcgagcgtacggtagatttgcctgcgggcacgaagtatgttgctttccgtcactacaattgctcggatttgaactacattcttttggatgatattcagttcaccatgggtggcagccccaccccgaccgattatacctacacggtgtatcgtgatggtacgaagatcaaggaaggtttgaccgaaacgaccttcgaagaagacggcgtagctacgggcaatcatgagtattgcgtggaagtgaagtacacagccggcgtatctccgaaagagtgtgtaaacgtaactgttgatcctgtgcagtttaatcctgtacagaacctgaccggtagtgcagtaggtcagaaagtaacgcttaagtgggatgcacctaatggtaccccgaatccgaatcccggaacaactacactttccgaatcattcgaaaatggtattcctgcctcatggaagacgatcgatgcagacggtgacggcaacaattggacgacgacccctcctcccggaggcacctcttttgcaggtcacaacagtgcgatctgtgtctcttcggcttcttatatcaactttgaaggccctcagaaccctgataactatctggttacaccggagctatctcttcctaacggaggaacgcttactttctgggtatgtgcacaagatgccaattatgcatcagagcactatgccgtgtatgcatcttctacgggtaacgacgcttccaacttcgccaacgctttgttggaagaagtgctgacggccaagacagttgttacggcacctgaagccattcgtggcactcgtgttcagggcacctggtatcaaaagacggtacagttgcctgcgggtactaagtatgttgccttccgtcacttcggctgtacggacttcttctggatcaacctcgatgatgttgagatcaaggccaacggcaagcgcgcagacttcacggaaacgttcgagtcttctactcatggagaggcaccagcggaatggactactatcgatgccgatggcgatggtcagggttggctctgtctgtcttccggacaattggactggctgacagctcatggcggcaccaacgtagtagcctctttctcatggaatggaatggctttgaatcctgataactatctcatctcaaaggatgttacaggcgcaacgaaggtaaagtactactatgcagtcaacgacggttttcccggggatcactatgcggtgatgatctccaagacgggcacgaacgccggagacttcacggttgttttcgaagaaacgcctaacggaataaataagggcggagcaagattcggtctttccacggaagccaatggcgccaaacctcaaagtgtatggatcgagcgtacggtagatttgcctgcgggcacgaagtatgttgctttccgtcactacaattgctcggatttgaactacattcttttggatgatattcagttcaccatgggtggcagccccaccccgaccgattatacctacacggtgtatcgtgatggtacgaagatcaaggaaggtttgaccgaaacgaccttcgaagaagacggcgtagctacgggcaatcatgagtattgcgtggaagtgaagtacacagccggcgtatctccgaaagagtgcgtaaacgtaactgttgatcctgtgcagttcaatcctgtacagaacctgaccggtagtgcagtcggccagaaagtaacgctcaagtgggatgcacctaatggtaccccgaatccgaatccgggaacaacaacactttccgaatcattcgaaaatggtattcctgcctcatggaagacgatcgatgcagacggtgacggcaacaattggacgacgacccctcctcccggaggcacctcttttgcaggtcacaacagtgcgatctgtgtctcttcggcttcttatatcaactttgaaggccctcagaaccctgataactatctggttacaccggagctttctcttcctaacggaggaacgcttactttctgggtatgtgcacaagatgccaattatgcatcagagcactatgccgtgtatgcatcttctacgggtaacgacgcttccaacttcgccaacgctttgttggaagaagtgctgacggccaagacagttgttacggcaccggaagccattcgtggtactcgtgttcagggcacctggtatcaaaagacggtacagttgcctgcgggtactaagtatgttgccttccgtcacttcggctgtacggacttcttctggatcaacctcgatgatgttgagatcaaggccaacggcaagcgcgcagacttcacggaaacgttcgagtcttctactcatggagaggcaccagcggaatggactactatcgatgccgatggcgatggtcagggttggctctgtctgtcttccggacaattgggatggctgacagctcatggcggcaccaacgtagtagcctctttctcatggaatggaatggctttgaatcctgataactatctcatctcaaaggatgttacaggcgcaacgaaggtaaagtactactatgcagtcaacgacggttttcccggggatcactatgcggtgatgatctccaagacgggcacgaacgccggagacttcacggtcgttttcgaagaaacgcctaacggaataaataagggcggagcaagattcggtctttccacggaagccaatggcgccaaacctcaaagtgtatggatcgagcgtacggtagatttgcctgcgggcacgaagtatgttgctttccgtcactacaattgctcggatttgaactacattcttttggatgatattcagttcaccatgggtggcagccccaccccgaccgattatacctacacggtgtatcgtgatggtacgaagatcaaggaaggtttgaccgaaacgaccttcgaagaagacggcgtagctacgggcaatcatgagtattgcgtggaagtgaagtacacagccggcgtatctccgaaagagtgcgtaaacgtaactattaatccgacacagttcaatcctgtacagaacctgacggcagaacaagctcctaacagcatggatgcaatccttaaatggaatgcaccggcatctaagcgtgcggaagttctgaacgaagacttcgaaaatggtattcctgcctcatggaagacgatcgatgcagacggtgacggcaacaattggacgacgacccctcctcccggaggctcctcttttgcaggtcacaacagtgcgatctgtgtctcttcggcttcttatatcaactttgaaggtcctcagaaccctgataactatctggttacaccggagctttctcttcctggcggaggaacgcttactttctgggtatgtgcacaagatgccaattatgcatcagagcactatgccgtgtatgcatcttctacgggtaacgacgcttccaacttcgccaacgctttgttggaagaagtgctgacggccaagacagttgttacggcaccggaagccattcgtggtactcgtgttcagggcacctggtatcaaaagacggtacagttgcctgcgggtactaagtatgttgccttccgtcacttcggctgtacggacttcttctggatcaaccttgatgatgttgtaatcacttcagggaacgctccgtcttacacctatacgatctatcgtaataatacacagatagcatcaggcgtaacggagactacttaccgagatccggacttggctaccggtttttacacgtacggtgttaaggttgtttacccgaacggagaatcagctatcgaaactgctacgttgaatatcacttcgttggcagacgtaacggctcagaagccttacacgctgacagttgtaggaaagacgatcacggtaacttgccaaggcgaagctatgatctacgacatgaacggtcgtcgtctggcagcgggtcgcaacacggttgtttacacggctcagggcggccactatgcagtcatggttgtcgttgacggcaagtcctacgtagagaaactcgctgtaaagtaa

SEQ ID NO: 557 - DNA, 6615 bp, Porphyromonas gingivalis W83
atgaaaacatctgaaagaatattaagttatttcttcctcttatgtgctgtattcagtctgggctcatgcgaaggactttatgcacaggtaactttcccaaattattcgcctacggcggcttcgtccattgctgtatgttctggagaagagacattgatcattgactttactgtagtccaggaggattcgaatggtatcaaagttaatgtgaaacttgccgacggtgtcgagtatgtggtcggaacggctgtcgtaagtgttacacagggcaatgcagtgacggtggcggaaaccaatgtttctaatccgaacgaacctgtatttacggtaaaatcggcggatggaaacaatgtggtagagcttggaaccatcgttaagctgacgattaagaggagagctgtctgtaccgcatggagcaatgccattaatgctgccgaaacgggttttgtcttcaaagacaaggtaacggtgactatcggcgatcatagtgatagcaaggaatcaaactcctattcggtaaactatccgaacctgacgatcaaacagcctgcgccgcaagtgaacaagcagattggggagaccatcgtacgagagttttctataaccaatggttctcagaacccgacccagacagtttatctttcgatagagtatcccgatgaagcctacctcacaggggtgggggcgatgacgcttcaggctaaactgggtgcttccggcacctatgccgatcttactcctaccgtcactaacggtaaggtccgcatctatacactttcgggttccagtttggggcctgatcatctcttgaccaacggcgagatcatctatctgaaagaaacatttaagctgaaaacttgtgcaccggttacggtctatagggtaggttggggttgtagcatagatagccagtgtgagataaaaactaccgctgctacaattactatggcagctggtgcggctaatatcacgggatattcagttactggtcctgattatcgttctccaactttttctctttgccaaccgtttgagttgactattaagttctcaaattccggtgctggtggctctatgggggcagcattcaatatcaatactattggtagaaacgactattatagaccaagagggtttgttttacacgaatttattgatgtcaaagtaaacggtaagccggtaacgaatttcaaaaccgatggctcagagctcgaccttcgttttgatggacagtttacagaagatcctgacggaccgggggttggtttggatgatgttgacggtgacggattttatgatgatcttcctgtcggagctactattacgattactgtaacggtgcggctaaagtgtgatcagtttacggcatgcaacaacgctccaaatgatttgtccgataggggcttgattcttaaaacactatatcagacatcttgtgatagaacctcatggatagatcccaacacgtggttcaatctttctagtactcatttgtatttgtctcgtgagtcggtacaagatgcctctcacatgcctactgtaatagagaaggatacgcctttcgacctgaagataatgacttcctactattccatcctcagctcatataataatatatggtacgccaatcccaatacgcggtatgtggtagaaatagtattcccgcaaggtatgactatgcctcccaaatcggatatagaatggaccaatataaaaaatcatccgatagacgggtccttagttttcactccaccgattaacctccctgatgcaaatatcacgacatcaggaaacacaatgactatcgtttcgcccagccaagaaagaggttttgtaaccctccatggtgtgaaatacgactgtacaaataatcacgaaatggttgtggagtataagattagagaggtattcaactaccttcacttccctgattgtctttgcccggtaggtcctattatgtgtaacacggcaaagcgttatgttttgggctgcgatcctccctgcggtagaggtgcggaaacttcggtgcctaagatagaacgtgccgacaattcgttgggctggacggattatacgatgcggacccgtcaatctcgtagcaatatatcggcttacgacttggctaaagccctatatatggacgaagtcaacattacagcgacttctatccagcatggtactgcttcgtctttgggcgcccgttttgttttggctacgggtgtcgatcgagtagaaacgcttactcctctttcggccgatattaagatcttccgtgatggggttcagattgtatcggtagatggatatacgacattccgttcaatacgccgaaataataatgcagagcaggtgatcgactgggattttacttcaatccttcctgctggtggattgcttgatagagacaaagtggatgttgttacccgttatcgggtaacatcccagaatgctcatagagtagatacgcaagtcggtagggagtggttcttctacaactctaccgccaatgtgtcaccgatatgggatgaagccaatccgttaacttgtctcatacttgtgcccgagatatacatcatgggtacttttgttgtaaacggtaccgatccacatgtcatttcacaatgtactccaacagatctgggacgcgttgctaaccactacgcccgtcgtttcggctctggtgcatttgaatatgccaatgaatatcgtcctggtgtaaagattagaaatatctatctgaaagtaccgaagtcctacacgctgaatagggtggagtatagcaatcaccgtaaccatagttcgttaggtacaaccatgcctttcgaggaaataaatcatacagatgtgacttcacagggtgaatataacatctataagtatcaacttgcagacaacgaaaaggcgcacttcaatattacagtaaaaaatgcctatggagcagctcttaaagtaaatgtatctcccacttgtgcgtcgtctgctgtagcaactaattatgataaaatttcatactatgtcgattacattgactattactattatgcagcaacgcagccaacagtacctaatagccttgacatagtagccgatcaatcggctggcagcaacggaatctacagtgtttccgccctcaatgtttacaacaggcctatcctttatactaacaaaccttctattgcgctcgtcaatcagtcaggtgaggtagagcttgtgggtaaaacgggagagtggaagctgcgtatcagcaacccatcgagtgcaacggctccctatgtttggttggcattgcctacaacatcggggctgaccatcgaaaaagtaactgatgcggcaggtactgaaatggcgtttacaacttattctggtggcaagatgtatcgtttgtcggaagctggtgttccagtaggttctgcgcttgactataccattcactttacctattctggttgctctcctatcgctttgaaggcgatggggggctggaactgtagtgcatatccccttagtttggatgagtatgtttgcagttcgcaggtgatcgatctcaagctcaagccactgccagctgccatggagcttactgagatagctgttccagatcctacagctgctgctacattgtgtagtacattggaatatatttacagcattcaatcgacagataatgcgaacgtttatagtcctactttcagcatcttccccgaagagggattggtggtgacaccgaatcaggtacaggtggaatatcctgccggttccggtaattgggctgcactcaatgtggtcaataattccgtcaatctgttgcagcatcctgcattgactaccataggctatctcaagggcctgaaagagggggaatccaacgacaatcaacgtaaaattttggtgaagttctacataaagaccgagtgttcgttcgtatctggcaagaacttccgtgtaagagctgacggccgtaatgcttgtaatcagaatgccaagggatcgggtcttgccataagtacgcctccaattagaataaatggagctatagagccctacacgacttctgcttctacgcagcttgttacgaccacaacatcacaatcggactgtaaagctcccaaaagagtaaaagtggtgcaaacggtcgtaggtggagaaactacccccaaggcatatttggaaatcacgctgccgttgggctttaagtatgtgacgggttcttatgctccggacaatacgcatccgggaggagtcaatgcctcacctgccggaacggaagaagtcactttgaccgcgaacggtgaagacaagattaagataaatgtcaaggccggtctgacgtcaggtcaatcgtttgcttatacactcgaaatgaaggaagacgatgataatgtgccggcttgtggcaatcataccatcgaaattgtcaatgttgaggagattgaaggtttgtggtgtgaaggcgttcagtgtgcagaaactttggtcgtcacgggtgccaacaagtttgaatttgagcttgataagccttacttggatattacggttatttcagcagtatcgactttcagtggtggtaaggaaaatcttacaattgagtataaggtaagcaatacatcgaccacccagcctctgaaaccgggagcggttgtaacgctgttcagcgataaggataacaatcaagtcttctccggcggagatgttgctgttgcaacacaggagttggtcgcagaaataactaataccacacctcttacgcagataatgaaggtaaaaggagtgagctcttcccatacgggcaatttggttcttacgatactgcccaaagacggttgctactgtgagatcaaatcccctatggtcacgttaaaccatcttccttcgaattactggatcggaggaactgtaggtaagcctaacgaatggaaagagccgaacaactggaccaatgaccaagttcccgatgcggcagaggatgttgaattcgccactgaggtgaataacccgactgatccgaataatccgaagtcgggtcctgcgaaggagaacctgcatctggacgatatacaccagaatggcacagccggtcgcgttatcggcaacctgatcaatgactctgacaaagatctggtaatcacaacgggcaatcaattgacgatcaacggcgtggttgaggataacaatccgaatgtcggtacgatcgtcgtgaagtcgtcgaaagacaatcctacggggacgttgcttttcgccaatccgggcaataatcaaaatgtaggggggactgtcgagttttacaatcagggatatgattgtgccgattgtggtatgtatcgcaggagctggcagtatttcggtatccctgtcaatgaatcagattttccatatgatcatgttgatggaaacgcgaccgtcaaccaatgggttgagcctttcaatggcgataagtggcggcctgcaccttatgcacctgatacaaagcttcagaaattcaagggctatcagatcacgaatgacgtgcaggcacagcctacgggagtttacagcttcaagggtacgctttgtgtgtgcgatgccttcctgaacctgacacgcacgtccggtgtcaactactcgggcgccaacttgatcggcaactcatacactggagctatcgacatcaagcaaggtattgtcttcccgccggaagtcgagcagacggtgtatctgttcaacacgggaacacgcgaccagtggcgtaagcttaatggaagcacggtttcaggctatcgagccggtcagtacctctctgtacctaagaatacagcgggtcaggacaatcttccggatcgtattccatcgatgcattccttcttggtgaagatgcagaacggagcctcttgtacgttgcagatcttgtacgataagctgctcaagaacacgactgtaaacaacggtaatggtacgcagatcacatggcgatccggcaactccggatcggcgaatatgccgtcacttgtgatggatgttcttggtaatgagtcggccgaccgtttgtggatctttaccgatgggggtctttcgttcggattcgacaacggctgggatggtcgcaagctgactgaaaaaggtttgtcacaactttatgcgatgtctgacatcggtaatgataaattccaggttgcaggggttccggagttgaataacctgctgatcggcttcgatgcggataaggatggtcaatacacgttggagtttgctctttcggatcattttgcgaaaggcggagttttccttgaggatcttagccgtggagttacacggcgagtagtcgacggcggttcgtattcattcgatgccaagcgaggagactccggggctcgtttccgtctctcttatgacgaagagtgggttgaatcggcagaggtttctgttttggttggtacggccgggaagcgaatcgttatcacgaataacagtgagcatgcctgtcaggccaatgtttatacaactgacggaaaacttctgattcgattggacgtaaaacccggaagtaagtctatgacggaaccattggtcgatggagtctacgttgtcagtctgcaaagtcctgccacgagtagcaatgtaaggaaagttgtagtcaactaa

SEQ ID NO: 558 - DNA, 2823 bp, Porphyromonas gingivalis W83
atgaacaaattttacaaatcacttttgcagtcaggactggctgccttcgtgtcgatggcaactgcactgaccgcttctgcacagatttcgttcggaggggaacccttgagtttctcttcaagatccgccggaacgcattcattcgacgatgcaatgactatccgccttactccggatttcaatccggaagacctgatcgcacagagccgttggcaatcgcaaagagatggccggcccgtccggataggacaagtaataccggtggatgtggactttgcatccaaggcttcgcacatctcttccatcggagacgtagatgtatatcgcctgcaattcaagttggaaggagccaaagccattacgctttattacgatgcattcaatattccggagggcggacgcctctatatctatacccccgaccatgaaattgtgttgggagcatatacgaacgccactcatcgccgcaacggagcttttgccacagagccggtaccggggagtgagcttattatggattatgaagtgtctcgcggagggactttgcctgacatcaagatctccggtgcgggttatatattcgacaaagtcggcggacgccccgtaacggataaccattacgggatcggtgaggacgattccgattcggattgcgagatcaacatcaattgtcctgaaggtgcagactggcaggcagagaagaacggtgtggtgcaaatgatcatggtaaaaggacagtatatctcaatgtgctcaggcaacctgctcaataatacgaaaggagactttactccgctgatcatttctgccggacactgtgcttccataacaaccaatttcggtgtaacgcaatccgagttggataagtggatcttcactttccactatgaaaaaagaggatgcagcaatggtacattggccatcttccgtggcaacagtatcatcggagcttccatgaaggctttcctcccgatcaaaggtaaatccgatggtctcttgctgcaactcaacgatgaagtccctctgcgctatcgtgtctattacaatggatgggacagtacgcccgatattccctcgagcggtgccggtattcatcatccggccggagatgccatgaagatttccatcctaaagaagactccggctctgaatacatggatctcctccagtggttccggagggactgacgatcacttctatttcaaatacgatcaaggtggtacggaaggaggatcgtccggttcttctctcttcaatcagaataagcacgtggtcggcacactgaccggaggtgccggcaattgtggcgggacggagttctacggcagactgaacagtcattggaacgagtatgcatccgatggcaatacgagccgcatggacatctatctggatccccaaaacaatggccagacgaccatcctcaacggaacgtatcgtgacggttataagcctttgccctctgtgccccggctattgttgcagtctacaggcgatcaggtcgaattgaattggacggctgttcctgccgatcaatatccatcatcttatcaggtcgaataccacatattccgaaatggaaaggaaatagctacgacaaaggagttgtcctattcggatgccatcgacgaaagtattatcggtagcggtatcattcgatacgaagtaagcgcacgcttcatttatccctcgccgttggatggagtggaatcttataaggatacggacaagacttctgccgaccttgccataggagacattcagaccaagctgaagccggacgtaacacctctccccggaggaggagtatcattaagctggaaagttcctttcttaagccagttggtttcccgattcggagaaagccccaatcctgtgttcaaaacctttgaagtgccctatgtttctgccgcagccgcacaaacccccaatcctcccgttggcgtagtcattgcagacaagtttatggccggtacatatcccgaaaaggctgctatcgctgccgtttatgtaatgccatccgctccggactctactttccacctcttcctcaagagcaacacaaacagaagattgcagaaggtgacaactccctccgattggcaggccggaacatggttgaggatcaatttggataagccgttcccggtgaataatgaccatatgctttttgccggtatcagaatgcctaataagtacaagctcaatcgtgctatccgttatgtaagaaatccggataaccttttctccattaccggtaagaagatttcatataacaacggagtctctttcgaaggctacggaataccctcgctcttgggctatatggctatcaaatatctggtggtaaataccgatgctccgaagatcgatatgtcgcttgtacaggagccttatgctaagggaacgaatgtggctccattccccgaattggtcggcatatatgtctataagaacggaacatttatcggcacacaggatccatccgtcacaacttattcggtttcagacggaacagagagcgatgaatacgaaataaaactggtatataagggatcgggcatttcgaatggcgttgctcagattgagaataacaatgctgtcgttgcatatccgtctgttgtaacagatcgtttcagcattaagaacgctcatatggttcacgctgccgccctctactcattggatggcaagcaggttcgttcttggaacaacctccgcaatggcgtgacattcagtgttcaaggacttacggccggtacttatatgctcgttatgcagacggcaaacggccctgtgagccaaaagatcgtgaagcagtag

SEQ ID NO: 559 - DNA, 5121 bp, Porphyromonas gingivalis W83
atgaaaaacttgaacaagtttgtttcgattgctctttgctcttccttattaggaggaatggcatttgcgcagcagacagagttgggacgcaatccgaatgtgagattgctcgaatccactcagcaatcggtgacaaaggttcagttccgtatggacaacctcaagttcaccgaagttcaaacccctaagggaatggcacaagtgccgacctatacagaaggggttaatctttctgaaaaagggatgcctacgcttcccattctatcacgctctttggcggtttcagacactcgtgagatgaaggtagaggttgtttcctcaaagttcatcgaaaagaaaaatgtcctgattgcaccctccaagggcatgattatgcgtaacgaagatccgaaaaagatcccttacgtttatggaaagagctactcgcaaaacaaattcttcccgggagagatcgccacgcttgatgatccttttatccttcgtgatgtgcgtggacaggttgtaaactttgcgcctttgcagtataaccctgtgacaaagacgttgcgcatctatacggaaatcactgtggcagtgagcgaaacttcggagcaaggcaaaaatattctgaacaagaaaggtacatttgccggctttgaagacacatacaagcgcatgttcatgaactacgagccagggcgttacacaccggtagaggaaaaacaaaatggtcgtatgatcgtcatcgtagccaaaaagtatgagggagatattaaagatttcgttgattggaaaaaccaacgcggtctccgtaccgaggtgaaagtggcagaagatattgcttctcccgttacagctaatgctattcagcaattcgttaagcaagaatacgagaaagaaggtaatgatttgacctatgttcttttgattggcgatcacaaagatattcctgccaaaattactccggggatcaaatccgaccaggtatatggacaaatagtaggtaatgaccactacaacgaagtcttcatcggtcgtttctcatgtgagagcaaagaggatctgaagacacaaatcgatcggactattcactatgagcgcaatataaccacggaagacaaatggctcggtcaggctctttgtattgcttcggctgaaggaggcccatccgcagacaatggtgaaagtgatatccagcatgagaatgtaatcgccaatctgcttacccagtatggttataccaagattatcaaatgttatgatccgggagtaactcctaaaaacattattgatgctttcaacggaggaatctcgttggccaactatacgggccacggtagcgaaacagcttggggtacgtctcacttcggcaccactcatgtgaagcagcttaccaacagcaaccagctaccgtttattttcgacgtagcttgtgtgaatggcgatttcctattcagcatgccttgtttcgcagaagcattgatgcgtgcacaaaaagatggtaagccgacaggtactgttgctatcatagcgtctacgatcaaccagtcttgggcttctcctatgcgcgggcaggatgagatgaacgaaattctgtgcgaaaaacacccgaacaacatcaagcgtactttcggtggtgtcaccatgaacggtatgtttgctatggtggaaaagtataaaaaggatggtgagaagatgctcgacacatggactgtattcggcgacccctcgctgctcgttcgtacacttgtcccgaccaaaatgcaggttacggctccggctcagattaatttgacggatgcttcagtcaacgtatcttgcgattataatggtgctattgctaccatttcagccaatggaaagatgttcggttctgcagttgtcgaaaatggaacagctacaatcaatctgacaggtctgacaaatgaaagcacgcttacccttacagtagttggttacaacaaagagacggttattaagaccatcaacactaatggtgagcctaacccctaccagcctgtttccaacttgactgctacaacgcagggtcagaaagtaacgctcaagtgggatgcaccgagcacgaaaaccaatgcaaccactaataccgctcgcagcgtggatggcatacgagaactggttcttctgtcagtcagcgatgcccccgaacttcttcgcagcggtcaggccgagattgttcttgaagctcacgatgtttggaatgatggatccggttatcagattcttttggatgcagaccatgatcaatatggacaggttatacccagtgatacccatactctttggccgaactgtagtgtcccggccaatctgttcgctccgttcgaatatacggttccggaaaatgcagatccttcttgttcccctaccaatatgataatggatggtactgcatccgttaatataccggccggaacttatgactttgcaattgctgctcctcaagcaaatgcaaagatttggattgccggacaaggaccgacgaaagaagatgattatgtatttgaagccggtaaaaaataccatttccttatgaagaagatgggtagcggtgatggaactgaattgactataagcgaaggtggtggaagcgattacacctatactgtctatcgtgacggcacgaagatcaaggaaggtctgacggctacgacattcgaagaagacggtgtagctgcaggcaatcatgagtattgcgtggaagttaagtacacagccggcgtatctccgaaggtatgtaaagacgttacggtagaaggatccaatgaatttgctcctgtacagaacctgaccggtagtgcagtcggccagaaagtaacgcttaagtgggatgcacctaatggtaccccgaatccaaatccaaatccgaatccaaatccgaatcccggaacaactacactttccgaatcattcgaaaatggtattcctgcctcatggaagacgatcgatgcagacggtgacgggcatggctggaagcctggaaatgctcccggaatcgctggctacaatagcaatggttgtgtatattcagagtcattcggtcttggtggtataggagttcttacccctgacaactatctgataacaccggcattggatttgcctaacggaggtaagttgactttctgggtatgcgcacaggatgctaattatgcatccgagcactatgcggtgtatgcatcttcgaccggtaacgatgcatccaacttcacgaatgctttgttggaagagacgattacggcaaaaggtgttcgctcgccggaagctattcgtggtcgtatacagggtacttggcgccagaagacggtagaccttcccgcaggtacgaaatatgttgctttccgtcacttccaaagcacggatatgttctacatcgaccttgatgaggttgagatcaaggccaatggcaagcgcgcagacttcacggaaacgttcgagtcttctactcatggagaggcaccagcggaatggactactatcgatgccgatggcgatggtcagggttggctctgtctgtcttccggacaattggactggctgacagctcatggcggcaccaacgtagtaagctctttctcatggaatggaatggctttgaatcctgataactatctcatctcaaaggatgttacaggcgcaacgaaggtaaagtactactatgcagtcaacgacggttttcccggggatcactatgcggtgatgatctccaagacgggcacgaacgccggagacttcacggttgttttcgaagaaacgcctaacggaataaataagggcggagcaagattcggtctttccacggaagccgatggcgccaaacctcaaagtgtatggatcgagcgtacggtagatttgcctgcgggcacgaagtatgttgctttccgtcactacaattgctcggatttgaactacattcttttggatgatattcagttcaccatgggtggcagccccaccccgaccgattatacctacacggtgtatcgtgatggtacgaagatcaaggaaggtttgaccgaaacgaccttcgaagaagacggcgtagctacgggcaatcatgagtattgcgtggaagtgaagtacacagccggcgtatctccgaagaaatgtgtaaacgtaactgttaattcgacacagttcaatcctgtaaagaacctgaaggcacaaccggatggcggcgacgtggttctcaagtgggaagccccgagcgcaaagaagacagaaggttctcgtgaagtaaaacggatcggagacggtcttttcgttacgatcgaacctgcaaacgatgtacgtgccaacgaagccaaggttgtgctcgcagcagacaacgtatggggagacaatacgggttaccagttcttgttggatgccgatcacaatacattcggaagtgtcattccggcaaccggtcctctctttaccggaacagcttcttccgatctttacagtgcgaacttcgagtatttgatcccggccaatgccgatcctgttgttactacacagaatattatcgttacaggacagggtgaagttgtaatccccggtggtgtttacgactattgcattacgaacccggaacctgcatccggaaagatgtggatcgcaggagatggaggcaaccagcctgcacgttatgacgatttcacattcgaagcaggcaagaagtacaccttcacgatgcgtcgcgccggaatgggagatggaactgatatggaagtcgaagacgattcacctgcaagctatacctatacagtctatcgtgacggcacgaagatcaaggaaggtctgaccgaaacgacctaccgcgatgcaggaatgagtgcacaatctcatgagtattgcgtggaagttaagtacacagccggcgtatctccgaaggtttgtgtggattatattcctgacggagtggcagacgtaacggctcagaagccttacacgctgacagttgtaggaaagacgatcacggtaacttgccaaggcgaagctatgatctacgacatgaacggtcgtcgtctggcagccggtcgcaacacggttgtttacacggctcagggcggctactatgcagttatggttgtcgttgacggcaagtcttacgtagagaaactcgctatcaagtaa

SEQ ID NO: 560 - DNA, 1455 bp, Porphyromonas gingivalis W83
atgaaaagaaaaccgctattctcagcccttgtaatcctttccggcttcttcggatcggttcacccggcctcagcacagaaagttcctgcacccgtcgatggcgagcgcattatcatggagctaagtgaagccgatgtggagtgtacaatcaaaatagaagccgaggatggctatgccaacgacatttgggcagacctcaacggaaacggcaagtacgattcgggggagaggctcgattcaggtgagtttcgtgatgttgagttcagacaaacaaaggccatcgtctatggcaaaatggccaaattcttgtttagaggttcttctgcaggggactatggtgctacctttatagatattagcaattgtaccggcctgactgctttcgactgctttgccaatctgctgacagaactcgatctgtccaaagcaaacggtctgacttttgtaaactgcggcaaaaaccagctgaccaagcttgacctgcccgcaaatgcggacattgagacgctgaactgctccaaaaacaagataacgagtctcaacctatcgacctataccaagctgaaagagctttatgtgggcgacaacgggctgacagccttggatctctccgccaatacgctcctcgaagagctggtgtattctaacaacgaggtgactacgataaacctgtctgccaatacgaacttgaaaagcctgtattgcataaacaataagatgaccggactcgatgtcgcagccaacaaagagctgaaaatactccactgcaacaacaatcagctgaccgccctcaatctctcggccaataccaagctgacgactctaagcttcttcaacaacgagctgacaaatatcgatctctccgacaacacggctttggagtggcttttctgcaacggcaataagctgacgaagttagatgtatctgccaacgccaatctgatagcactgcaatgcagcaacaaccagctgactgctctggatctgtcaaaaacgccgaaactgacaacgttgaattgctactccaaccggatcaaagataccgccatgcgtgcattgatcgaaagcctgcctacgatcactgaaggagaaggcaggttcgttccttacaacgacgatgaaggaggagaagaggagaacgtgtgtacaaccgaacacgtggaaatggccaaggccaagaattggaaggtacttacctcgtggggagagcctttccccggaataacggctttgatttccatcgaaggtgagagcgaatattccgtatatgctcaagatggcatcctctacctctccggtatggagcagggcttgcccgttcaggtatataccgtgggaggaagcatgatgtactcatctgtcgcttccggatcagccatggaaatacagctcccgagaggtgcagcctatgtagtacgtatcggcagccatgcgatcaaaaccgcgatgccgtaa

SEQ ID NO: 561 - DNA, 903 bp, Shigella flexneri 2a str. 2457T
atgaaacgagctattaccctgtttgctgtactgctgatgggctggtcggtaaatgcctggtcattcgcctgtaaaaccgccaatggtaccgctatccctattggcggtggcagcgctaatgtttatgtaaaccttgcgcctgtcgtgaatgtggggcaaaacctggtcgtagatctttcgacgcaaatcttttgccataacgattatccggaaaccattacagactatgtcacactgcaacgaggctcggcttacggcggcgtgttatctaatttttccgggaccgtaaaatatagtggcagtagctatccatttccgaccaccagcgaaacgccgcgggttgtttataattcgagaacggataagccgtggccggtggcgctttatttgacgcctgtgagcagtgcgggcggggtggctattaaagctggttcattaattgccgtgcttattttgcgacagaccaacaactataacagcgatgattttcagtttgtgtggaatatttacgccaataatgatgtggtggtgcccactggcggttgtgatgtttctgctcgtgatgtcaccgttactctgccggactaccctggttcagtgccaattcctcttaccgtttattgtgcgaaaagccaaaacctggggtattacctctccggcacaaccgcagatgcgggcaactcgattttcaccaataccgcgtcgttttcaccagcgcagggcgtcggcgtacagttgacgcgcaacggtacgattattccagcgaataacacggtatcgttaggagcagtaggaacttcggcggtaagtctgggattaacggcaaattacgcacgtaccggagggcaggtgactgcagggaatgtgcaatcgattattggcgtgacttttgtttatcaataa

SEQ ID NO: 562 - DNA, 2868 bp, Shigella flexneri 2a str. 2457T
atgggcatcaaacaacacaatgggaataccaaagccgatcgtctcgctgaattaaaaatccgttcgccctcaattcaactgataaaatttggcgctattggtttgaatgcaattatcttttcccccctgctgatagctgctgatacaggaagtcaatatggcaccaatattactattaatgatggtgacagaattacaggagataccgccgatccatcaggaaacctctatggtgtaatgaccccagcaggaaacacgcctggcaatatcaacctgggtaatgatgtcaccgtcaatgtcaacgacgcctctggatatgcaaaaggaatcattattcagggcaaaaacagctccctgacagctaaccgactcacagtagatgttgttggtcaaacctctgccatcggcattaacttaattggtgactatacccatgctgacttaggcacaggcagcaccattaagagtaacgatgacggcatcattattgggcatagctcaacactaacagccactcaattcaccattgaaaactcgaacggtataggcctaaccatcaatgactatggcaccagtgtcgatcttggaagcggaagtaaaatcaagaccgatggaagtacaggtgtttatatcggtggtctcaacggcaataacgccaatggtgctgcgcgttttacggcgacagacctgacaatcgatgttcagggctacagcgccatggggataaacgtacagaaaaactctgttgtcgatctcggaacaaacagtaccattaaaaccaatggcgataatgctcacggcctctggagctttggccaggttagcgcgaatgcactcactgttgatgtaactggagccgcggccaatggcgtcgaagttcgtggtggtacaaccactatcggtgcagatagccatatttcttccgcgcagggcggtggcctcgtcaccagtagttcagacgcgacaatcaatttttctggcacggcagcgcaacgaaacagcatcttttccggcggttcttatggtgcctcggcccagacggcaacggctgttatcaacatgcaaaataccgatattacggttgatcgtaatggcagtctggcgctgggtttgtgggcgctcagcggcggtagaataaccggagacagtttggctatcaccggcgcggcaggagccagagggatttatgccatgaccaacagccagatcgacctcacgagcgatctggtcattgatatgagtacacccgaccagatggccatcgcaacgcaacatgacgatggttatgccgccagccgcatcaacgcctcgggtcgtatgcttatcaacggtagcgttctttccaaaggtgggctaatcaatctggatatgcaccctgggtcggtttggacaggttcctccctcagcgataatgtcaatggcgggaaactggacgttgcaatgaataacagcgtctggaacgtaacaagtaattctaatctcgacacgctggcgctgagccattcaactgtcgattttgccagccacgggtcaactgccggcacatttaccacattaaacgtagagaacctgagcggtaacagtacctttattatgcgtgctgatgttgttggcgagggtaatggcgttaataatagaggggatttattgaatatcagcgggagtagtgctggtaatcacgtattggctatccgcaaccagggcagcgaggccacaacgggaaatgaagttctgacagtggtaaaaaccactgacggcgcggcctcgttcagcgcgtcttctcaggttgagttggggggatatctgtacgatgtgcgtaaaaatggcactaactgggagctttacgcttccgggacagttccggaaccgactcctaatcctgaacccacaccagctcccgctcagcctcccatagtcaaccccgatcctacgcctgaacccgctcccacgcctaaacccaccacgaccgcagatgctggcggcaattatctcaatgtcggttacttattgaactatgttgaaaaccgtacgctgatgcaacggatgggtgacttgcgaaatcagagtaaagacggtaatatctggttgcgcagttatgggggaagcctggactcctttgccagtggcaaactgagcggctttgacatgggttacagcggtatccagtttggtggggataaacgtctctctgatgtaatgccgttgtatgtcggtctgtatattgactcaacacatgcatcgccggactatagcggaggcgacggtaccgcacgttcagactacatgggaatgtacgccagttacatggcacaaaacggtttttacagcgatctcgttataaaagcatcgcgccagaaaaatagtttccacgtactggacagtcagaacaacggcgttaacgccaacggcactgcgaatggaatgagcatctccctggaagccgggcagaggttcaacctgtcccctactggttatgggttctatatagagccgcaaacccagcttacatacagccaccagaatgagatggctatgaaggcgagtaatggcctcaatatacatctgaatcactacgaatcgctgctggggcgtgccagcatgatactggggtatgacatcaccgcaggcaacagccagctgaatgtctatgtgaagactggcgctatccgcgagttttcaggggataccgaatatctgttgaacgactcccgggagaagtacagtttcaaaggtaatggctggaataacggcgtgggagtcagtgcacagtataacaaacagcacacattctatctcgaagcggattacacgcagggtaacctctttgatcagaagcaagtcaacggaggatatcgcttcagcttttaa

SEQ ID NO: 563 - DNA, 564 bp, Shigella flexneri 2a str. 2457T
atgagtaagtttgttaaaacagctattgctgcggcaatggtgatgggcgtgttcacctctacggcaacaatcgctgcgggtaacaacggtactgcacgtttttacggcaccattgaagactcagtgtgttctatcgttccggacgatcacaaactggaagttgatatgggtgatatcggtgccgaaaaactgaaaaataacggcaccaccacgccgaaaagtttccagattcgtctgcaagattgcgtatttgatactcaggaaacaatgaccactacctttactggtaccgtttcttctgcaaatagcggcaattattacaccattttcaataccgataccggtgcggcatttaacaatgttagcctggcgatcggtgactctctgggtacctcttacaaaagcggcatgggtattgaccagaaaatagtgaaagacacttctaccaacaaaggcaaagcgaagcagacactgaactttaacgcctggctggtcggcgcagctgatgcgccagatctgggtaattttgaagcaaataccaccttccagattacttacctgtaa

SEQ ID NO: 564 - DNA, 549 bp, Shigella flexneri 2a str. 2457T
atgaaaattaaaactctggcaatcgttgttctgtcggctctgtccctcagttccgcagcggctctggccgatactacgacggtaaatggtgggaccattcactttaaaggggaagttgttaacgccgcttgcgcagttgatgcaggctctgttgatcaaaccgttcagttgggacaggttcgtaccgctagcctgaagcaggctggagcaaccagctctgccgttggttttaacattcagctgaatgattgcgataccactgttgccacaaaagccgctgttgccttcttaggtacggcaattgatgctacgcgtactgatgtactggctctgcagagttctgctgcaggtagtgcaacaaacgttggcgtgcagatcctagacagaacaggcaatgctctgacgctggacggtgcgacatttagtgcacaaacaaccctgaataacggtaccaacaccattccgttccaggcgcgttattatgcaatcggcgaggcaaccccgggtgcagctaatgcggatgcaaccttcaaggttcagtatcaataa

SEQ ID NO: 565 - DNA, 1407 bp, Shigella flexneri 2a str. 2457T
atggcaagtatttcatcgctgggagtcgggtcaggtctggatttaagttcaatccttgatagcctcaccgccgcgcaaaaagcgacgctaacccctatttcaaatcagcaatcgtcgtttaccgctaaacttagcgcctacggtacgctgaaaagcgcgctgacgactttccagaccgccaatactgcattgtctaaagccgatcttttttccgccaccagcaccaccagcagcaccaccgcgttcagtgccaccaccgcgggtaacgccatcgccgggaaatacaccatcagcgtcacccatctggcgcaggcgcaaaccctgaccacgcgcaccaccagagatgatacgaaaacggcgatcgccaccagcgacagcaaactcaccattcaacaaggcgacgacaaagatccgattaccattgatatcagcgcggctaactcatcgttaagcgggatccgtgatgccatcaacaacgcaaaagcgggcgtaagtgcgagcatcattaacgtgggtaacggtgaatatcgtctgtcagtcacatcaaatgacaccggccttgataatgcgatgacactctcggtcagcggtgatgatgcgctacaaagttttatgggctatgacgccagtgccagcagcaacggtatggaggtctcggtcgccgcccagaatgcgcagctgacggtcaacaacgtcgccatcgagaacagcagcaacactatcagcgacgcgctggaaaacatcactctgaacctgaacgatgtcaccacgggcaaccagacgctaaccatcactcaggacacctccaaagtgcaaacggcgattaaagactgggtgaatgcctataactcgctaatagataccttcagcagcctgaccaaatacaccgccgtagatgcgggagctgatagccagagttctagcaatggcgcactgctcggcgactccacgctgcggacgattcagacgcagttgaagtcgatgctgagtaataccgtcagttcttccagctataaaacgctggcgcagattggtatcacgaccgatcccagcgatggcaaactggaactggatgccgacaaactcaccgctgcactgaaaaaagatgccagcggcgtaggtgcattgattgttggcgatggtaaaaaaaccggcatcacaaccaccatcggcagcaacctgaccagttggctttcgacaacgggcattattaaagccgctaccgatggcgttagtaaaaccctgaataagttaactaaagactacaacgccgccagcgatcgcattgatgcgcaggtcgcgcgctacaaagaacaatttacccaactggacgttttaatgacctcgttaaacagcaccagcagctacttaacgcagcagttcgaaaacaacagtaattccaagtaa

SEQ ID NO: 566 - DNA, 2121 bp, Shigella flexneri 2a str. 2457T
gtggagggtaaagctgataatgtcgtactggaaaatggcggacgcctggatgtgctgaccggacacacagccactaatacccgcgtggatgatggcggaacgctggatgtccgcaacggtggcaccgccaccaccgtatccatgggaaatggcggtgtactgctggccgattccggtgccgctgtcagtggtacccggagcgacggaaaggcattcagtatcggaggcggtcaggcggatgccctgatgctggaaaaaggcagttcattcacgctgaacgccggtgatacggccacggataccacggtaaatggcggactgttcaccgccaggggcggcacactggcgggcaccaccacgctgaataacggcgccatacttaccctttccgggaagacggtgaacaacgataccctgaccatccgtgaaggcgatgcactcctgcagggaggcgctctcaccggtaacggcagcgtggaaaaatcaggaagtggcacactcactgtcagcaacaccacactcacccagaaagccgtcaacctgaatgaaggcacgctgacgctgaacgacagtaccgtcaccacggatgtcattgctcagcgcggtacagccctgaagctgaccggcagcactgtgctgaacggtgccattgaccccacgaatgtcactctcgcctctggtgccacctggaatattcccgataacgccacggtgcagtcggtggtggatgacctcagccatgccggacagattcatttcacctccacccgcacagggaagttcgtaccggcaaccctgaaagtgaaaaacctgaacggacagaatggcaccatcagcctgcgtgtacgcccggatatggcacagaacaatgctgacagactggtcattgacggtggcagggcaaccggaaaaaccatcctgaacctggtgaacgccggcaacagtgcgtcggggctggcgaccagcggtaagggtattcaggtggtggaagccattaacggtgccaccacggaggaaggggcctttatccaggggaataagctgcaggccggtgcctttaactactccctcaaccgggacagtgatgagagctggtatctgcgcagtgaaaatgcttatcgtgcagaagtccccctgtatgcctccatgctgacacaggcaatggactatgaccggattctggcaggctcccgcagccatcagaccggtgtaagcggtgaaaataacagcgtccgtctcagcattcagggcggtcatctcggtcacgataacaacggcggtattgcccgtggagccacgccggaaagcagcggcagctatggcttcgtccgtctggagggtgacctgctcagaacagaggttgccggtatgtctgtgaccgcgggggtatatggtgctgctggccattcttccgttgatgttaaggatgatgacggctcccgtgccggcacggtccgggatgatgccggcagcctgggcggatacctgaatctgatacacaacgcctccggcctgtgggctgacattgtggcccagggaacccgccacagcatgaaagcctcatcggacaataacgacttccgcgtccggggctggggctggctgggttcgctggaaaccggtctgcccttcagtatcactgacaatctgatgctggagccgcaactgcagtacacctggcagggactctccctggatgacggccaggataacgccagttatgtgaagttcgggcatggcagtgcacaacatgtgcgtgccggcttccgtctgggcagccaccacgatatgaactttggtaaaggcacctcatcccgtgacaccctgcgcggcagtgccaaacacagtgtgcgtgaactgccggtgaactggtgggtacagccttctgttatccgcaccttcagctcccggggggacatgagcatgggtacagccgcagccggcagtaacatgacgttctcaccgtcacagaatggtacgtcactggacctgcaggccggactggaagcccgtgtccgggaaaatatcaccctgggcgttcaggccagttatgcccacagcatcaacggcagcagcgctgaaggttataacagtcaggccacactgaatgtaaccttctga

SEQ ID NO: 567 - DNA, 1209 bp, Shigella flexneri 2a str. 2457T
atggccttttctcaagcggttagcggattaaacgctgccgccaccaacctcgatgttattggcaacaatatcgccaactccgccacctacggctttaaatcaggcacggcctcttttgccgatatgtttgccggttcgaaagtgggactgggggtaaaagttgccggtatcactcaggactttaccgatggcacgaccaccaacaccgggcgaggtctggacgttgctatcagccagaacggttttttccgtctggtagacagcaacggttcggtgttctacagccgtaacggacaatttaagctggatgaaaaccgtaacctgttgaatacgcaaggtttacagctgacgggttacccggtaaccggtacgccgccgactattcagcaaggggcgaatccgaccaatatttcgatcccgaataccctgatggcagcgaaaactaccaccacggcgtcgatgcagatcaacctgaattccagtgatccgcttcctactgttacgccattcagcgccagcaatgcggatagctataacaaaaaaggttcggtgactgttttcgacagtcagggtaatgctcatgacatgagcgtctattttgtgaagaccggggataataactggcaggtctacacccaggatagcagtgatccaaacagcattgcgaagacagcgacaacactggaatttaatgctaatggcacattagtggatggtgcgatggcgaataatatcgcaaccggcgcaattaacggtgcagaacccgccacgtttagtctgagcttcctcaactccatgcagcaaaataccggcgctaacaacattgtggcaaccacccagaatggctacaaaccgggcgatctggtgagttatcaaatcaatgatgacggtacggttgtcggcaacaattccaacgaacaaacccaactgctggggcagattgtactggcgaactttgccaacaacgaaggtctggcatccgaaggcgacaacgtctggtctgcgacgcaatcttctggcgtggcgctgttggggacagccgggacgggaaactttggcactctgaccaacggtgcgctggaagcgtccaacgtcgatctcagtaaagaactggtcaatatgatcgttgcccagcgtaactataagtctaacgcccagaccatcaaaacccaggaccagatcctcaacacgcgggttaacttacgctaa

SEQ ID NO: 568 - DNA, 573 bp, Shigella flexneri 2a str. 2457T
atgaaactcgtgcacatggccagtggtttagcggttgcgattgcgttggcggcttgcgcagataaaagcgcggatattcagacgccagccccggctgcaaatacgtctatttcagcaacacaacaacctgctatccagcaaccgaatgtctccggtactgtctggatccgtcagaaagtcgcactgccgcctgatgctgtgctgaccgtgacactttctgacgcgtcgttagccgatgcaccgtcaaaagtgctggcgcagaaagcggtgcgtactgaaggtaaacagtcaccattcagctttgttctgccatttaacccggcagatgttcagccgaacgcgcgtattctgttgagtgcggcgattaccgtgaatgacaaactggtatttatcaccgataccgttcagccggtgatcaaccagggcggaactaaagccgacctgacattggtgccggtacagcaaaccgccgtgccggttcaggccagcggtggcgcaacgactaccgtaccttcgacttcaccaactcaggtgaatccgtcttcggcagttcccgctcctacgcaatattaa

SEQ ID NO: 569 - DNA, 699 bp, Shigella flexneri 2a str. 2457T
atgatcataaaaaaaagcggtggtcgctggcagctaagcctgctggcgagcgtggtaatcagtgccttttttctcaacacagcttacgcctggcaacaagaatatatcgttgatacgcaacccggacattccacagagcgttacacctgggatagtgatcatcaacctgattacaacgatattttgtcgcaacgtattcaaagtagccaaagggcgctgggactggaagtcaatctggcggaagaaactcctgtggatgtgaccagcagtatgagtatgggctggaattttcctttatatgaacaggttacaaccggcccggtcgcggcattacattacgatggcacaaccacctcgatgtataacgagtttggcgacagtactaccacgctgaccgatccgttatggcatgccagcgtgagtagcttaggctggcgtgttgactcccggcttggcgatctccgaccctgggcgcaaatcagctataaccagcaatttggcgagaatatctggaaggcgcaatcaggcctgagccggatgacggcgacaaaccagaacggcaactggctggatgtcaccgtaggcgctgatatgttgctcaatcaaaatattgccgcctatgctgcgctaactcaggcagaaaataccactaataatagcgactatctgtatacgatgggggttagcgccagattttaa

SEQ ID NO: 570 - DNA, 504 bp, Shigella flexneri 2a str. 2457T
atgaaatggtgcaaacgtgggtatgtattggcggcaatgttggcgctcgcaagtgcgacgatacaggcagccgatgtcaccatcacggtgaacggtaaggtcgtcgccaaaccgtgtacggtttccaccaccaatgccacggtagatctcggcgatctttattctttcagtcttatgtctgccggggcggcatcggcctggcatgatgttgcgcttgagttgactaattgtccggtgggaacgtcgagggtcactgccagcttcagcggggcagccgacagcaccggatattataaaaaccaggggaccgcgcaaaacatccagttagagctacaggatgacagtggcaacacattgaatactggcgcaaccaaaacagttcaggtggatgattcctcacaatcagcgcacttcccgttacaggtcagagcattgacggtaaatggcggagccactcagggaaccattcaggcagtgattagcatcacctatacctacagctga

SEQ ID NO: 571 - DNA, 1092 bp, Shigella flexneri 2a str. 2457T
atgaaaagagcgcctcttataacaggacttttgttgatatccacatcctgcgcttatgcctcctcaggagggtgtggagccgacagcactagcggtgcgacaaattacagcagtgtggttgatgatgttacggtgaaccagacagataacgtgacaggacgggagtttacctctgcaacgctaagtagcactaactggcaatacgcctgttcctgctctgcgggtaaggcagttaaacttgtctatatggtcagccccgtacttaccaccactggacatcagacaggatattacaaactcaatgacagcctggatattaaaaccacattacaggcaaacgacattccaggactcacaaccgaccaggttgtctctgttaacacccgattcacacagataaaaagcagcaccgtatattctgctgcaacccaaacgggtgtttgccagggtgacacgtctcgttatggacccgttaatattggtgcaaataccacctttaccctgtatgtcaccaagccatttctcggctcgatgaccattccgaaaacggatattgccgtcattaaaggcgcgtgggtcgatggaatgggaagcccgtctacaggtgacttccatgatttagtcaagttatcgattcagggaaatctcaccgccccacagtcgtgcaaaattaatcagggcgatgttattaaagttaattttggattcatcaatggtcagaagtttaccacccgcaatgccatgccagacggttttactccagtagactttgatatcacttatgactgtggtgatacttcaaagattaaaaactcgttgcaaatgcgcatcgacggtacaactggggtagtagaccagtacaacctggtcgccaggcgaagaagttcagacaatgtgcccgatgtcggtattcgtattgaaaatctcggcggcggagttgcaaatattccttttcagaacggtatccttcccgttgatccttccgggcatggcaccgtcaatatgcgcgcctggccagttaatctggtcggtggtgagctggaaacaggaaaatttcagggcacagccaccattaccgtcatggtgcggtaa

SEQ ID NO: 572 - DNA, 699 bp, Shigella flexneri 2a str. 2457T
atgcaaaaaaacgctgcgcatacttatgccatttccagcttgttggtgctttcactaaccggctgcgcctggataccctccacgccgctggtgcagggggcgaccagtgcacaaccggttcccggtccgacgcccgtcgccaacggttctattttccagtctgctcagccgattaactatggctatcaaccgctgtttgaagatcgtcgaccacgcaatattggcgatacgctgaccatcgtgttgcaggagaacgtcagcgccagcaaaagctcctctgcgaatgccagccgtgacggtaaaactaattttggctttgatactgtgccgcgctatttgcaggggctgtttggtaacgctcgtgccgatgtcgaagcctccggtggtaacacgttcaacggaaagggcggggccaatgccagcaatacctttagcggcacgttgacggtgacggttgaccaggtactggtcaacggcaacctgcatgtggtgggtgaaaaacagattgccattaatcagggtaccgaatttattcgcttctcgggcgtggttaatccacgcactatcagcggcagcaataccgtaccgtctactcaggtggcggatgcgcgtattgaatacgtaggcaatggctacattaacgaagcgcaaaatatgggctggttgcagcgtttcttccttaacctgtcgccaatgtaa

SEQ ID NO: 573 - DNA, 894 bp, Shigella flexneri 2a str. 2457T
atgaaacgacatctgaatacctgctacaggctggtatggaatcacattacgggcgctttcgtggttgcctccgaactggcccgcgcacagggtaaacgtggcggtgtggcggttgcactgtctcttgccgcggtcacgtcactcccggtgctggctgctgacatcgttgtgcacccgggtgaaacagtgaatggcggaacactggtaaaccatgacaaccagtttgtatccggaacagctgatggcgtgactgtcagtaccgggcttgagctggggccggacagtgacgaaaacaccggcgggcaatggataaaagcgggtggcacaggcagaaacaccactgtcaccgcaaatggtcgtcagattgtgcaggcaggaggaactgccagtgatacggttattcgtgatggcggagggcagagccttaacggactggcggtgaacaccacgctggataacagaggtgagcagtgggtacacgggggagggaaagctgccggtacaattattaaccaggatggttaccagaccataaaacatggcggactggcaaccggaaccatcgtcaacaccggtgcagaaggtggtccggagtctgaaaatgtgtccagcggtcagatggtcggagggacggctgaatccaccaccatcaataaaaatggccggcaggttatctggtcttcggggatggcacgggacaccctcatttacgccggtggtgaccagacggtacacggagaggcacataacacccgactggaggggggtaaccagtatgtacacaacggtggcacggcaacagagacgctgataaaccgtgatggctggcaggtgattaaggaaggaggaactgccgcgcataccaccatcaaccagaaagaaagctgcaggtga

SEQ ID NO: 574 - DNA, 498 bp, Shigella flexneri 2a str. 2457T
atgatgatgaaaactattaaacatcttctgtgctgtgccattgccgccagcgcattaatttccaccggggtgcatgctgcgtcctggaaagatgcgctctccagcgccgccagcgaacttggcaaccaaaacagcacgacacaggaaggcggttggtcgctcgcgtcattaactaacttgcttagcagcggaaaccaagccttaagcgcagataacatgaacaatgccgcaggcattctgcaatactgcgcgaagcaaaagctggcttcggtaaccgatgccgaaaacatcaagaaccaggtgctggaaaagctgggcctgaacagtgaagagcaaaaagaagacaccaactatctggacggtattcagggtttgctgaaaacaaaagatggtcagcaactcaatctggataacatcggaacgactccgctggcagaaaaggtgaaaaccaaagcctgcgatctggtgttaaagcaggggctgaacttcatttcctga

SEQ ID NO: 575 - DNA, 567 bp, Shigella flexneri 2a str. 2457T
atgtttaaaggacaaaaaacattggccgcactggccgtatctctgctgttcacagcacctgtttatgcggctgatgaaggatccggtgaaattcactttaaaggtgaagttattgaagcaccgtgtgaaatacatcaggatgatattgataaagaggttgaactcggtcaggtgaccaccagccacattaatcagtcacatcacagcgatgccgttgctgtcgacctgctcttagtcaactgtgatctggaaaactccagcaacggttccggtggcaagatttctaaagttgcagtcacctttgatagctcagcgaaaaccaccggcgcagatccgattctcaacaacaccagcacgggtgaagccaccggcgtcggcgtacgtttaatgaataaagatcaaagcaatatcgttttaggcaccgctactccagatatcgacctggctccgacctccagcgaacaaacgctgaatttctttgcctggatggaacaaattgatcaggctacacctgtaacgccaggcgcagttacggcgaatgcaacctacgtgctggattataaataa

SEQ ID NO: 576 - DNA, 1140 bp, Shigella flexneri 2a str. 2457T
atgagcgcgggaagcccaaaattcaccgttcgccgcattgcggctttgtcactggtttcgctatggctggcaggctgttctgacacttcaaatccaccggcaccggtcagctccgttaatggcaatgcgcctgcaaatactaattctggtatgttgattacgccgccgccgaaaatggggacgacgtctacagcgcagcaaccgcaaattcagccggtacagcagccacaaattcaggctactcaacaaccgcaaatccagccagtgcagccagtagctcagcagccggtacagatggaaaacggacgcatcgtctataaccgtcagtatgggaacattccgaaaggcagttatagcggcagtacctataccgtgaaaaaaggcgacacacttttctatatcgcctggattactggcaacgatttccgtgaccttgctcagcgcaacaatattcaggcaccatacgcgctgaacgttggtcagaccttgcaggtgggtaatgcttccggtacgccaatcactggcggaaatgccattacccaggccgacgcagcagagcaaggagttgtgatcaagcctgcacaaaattccaccgttgctgttgcgtcgcaaccgacaattacgtattctgagtcttcgggtgaacagagtgctaacaaaatgttgccgaacaacaagccaactgcgaccacggtcacagcgcctgtaacggtaccaacagcaagcacaaccgagccgactgtcagcagtacatcaaccagtacgcctatctccacctggcgctggccgactgagggcaaagtgatcgaaacctttggcgcttctgaggggggcaacaaggggattgatatcgcaggcagcaaaggacaggcaattatcgcgaccgcagatggccgcgttgtttatgctggtaacgcgctgcgcggctacggtaatctgattatcatcaaacataatgatgattacctgagtgcctacgcccataacgacacaatgctggtccgggaacaacaagaagtgaaggcggggcaaaaaatagcaaccatgggtagcaccggaaccagttcaacacgcttgcattttgaaattcgttacaaggggaaatccgtaaacccgctgcgttatttgccgcagcgataa

SEQ ID NO: 577 - DNA, 1098 bp, Shigella flexneri 2a str. 2457T
gtgattaaatttctctctgcattaattcttctactggttacgacggcggctcaggctgagcgtattcgcgatctcaccagtgttcagggggtaaggcaaaactcactgattggctatggcttggtagtggggctggatggcactggtgaccagacaacccagacgccgtttaccacacaaacgcttaataacatgctctcacagctgggaattaccgttccgacgggcaccaatatgcagctaaaaaacgtcgctgcggtaatggtgacagcgtcacttcctccgtttggacgtcaggggcaaaccatcgatgtggtggtttcttccatgggtaatgccaaaagcttgcgtggaggtacgttgttgatgacaccgcttaagggcgttgacagtcaggtgtatgcgctggcgcagggcaatattctggttggcggcgcaggagcctccgcaggcggtagcagtgttcaggttaaccaactgaacggtggacggatcaccaatggtgcggttattgaacgtgaattgcccagccagtttggcgtcgggaatacccttaatttgcaacttaacgacgaagatttcagcatggcgcagcaaatcgctgacaccatcaaccgcgtgcgtggatatggcagcgccaccgcgttagatgcgcggactattcaggtgcgcgtaccaagtggcaacagttcccaggtccgtttccttgccgatatccagaatatgcaggttaatgtcaccccgcaggacgctaaagtagtgattaactcgcgcaccggttcggtggtgatgaatcgcgaagtgaccctcgacagctgcgcggtagcgcagggaaatctctcagtaacagttaatcgtcaggccaatgtcagccagccagatacaccgtttggtggtggacagactgttgttactccacaaacgcagatcgatttacgccagagcggcggttcgctgcaaagcgtacgttccagcgccagcctcaataacgtggtgcgtgcgctcaatgcgctgggcgctacgccgatggatctgatgtctattttgcaatcaatgcaaagtgcgggatgtctgcgggcaaaactggaaatcatctga

SEQ ID NO: 578 - DNA, 525 bp, Shigella flexneri 2a str. 2457T
atgaaacgttcaattattgctgccgctgtcttttcttctttttttatgagcgctggagtatttgctgcagacgttgataccggaacattaaccattaaaggaaatattgcagaatctccgtgtaaattcgaagcgggtggtgattcagtaagtattaatatgccgactgtaccaaccactgtctttgaaggtaaagctaaatattctacctatgatgatgcagtcggtgtaaccagcagcatgttaaaaattagctgcccgaaagaagttgctggtgtaaaactctcgttgatcacaaacgacaaaataaccggtaacgataaggcgatagccagtagcaacgataccgtaggtgataacagcgatgtcctagatgtttctgcaccttttaacattgagagttataaaacagcggaaggtcaatatgctattccgtttaaagcaaaatacctgaaactgacagataactcagtgcaatcaggtgatgtgttatcttctctggttatgcgtgtggcgcaggattaa

SEQ ID NO: 579 - DNA, 582 bp, Shigella flexneri 2a str. 2457T
atggcggttcaaaagaatgttatcaaaggcatactggcaggtacgtttgcgctaatgctgagcggttgtgtcactgtgccggacgccattaaaggcagcagtaccacgccgcaacaagatttagttcgggtgatgagtgcgccgcagctgtacgttggtcaggaggcacgctttggtggcaaagtggttgcggtacaaaaccagcaagggaaaacccgcctggaaattgctaccgtaccgctggacagcggagctaggccgacgctgggagaaccttctcgcggtcgcatttatgccgatgtgaacggttttctggacccggtggatttccgtggacaactggttacggtagtcgggccaatcaccggtgcggttgacggcaaaatcggcaatacgccctataaatttatggtgatgcaagtaacgggttacaaacgttggcatttaacccagcaggtgattatgccgcctcagccgattgatccatggttttatggcggtcgtggctggccctatggctacggcggatggggctggtataatcccggccccgcgagagtacaaacagttgtaaccgaataa

SEQ ID NO: 580 - DNA, 531 bp, Shigella flexneri 2a str. 2457T
atgagaaacaaacctttttatcttctgtgcgcttttttgtggctggcggtaagtcgcgttttggctgcggatagcacgattactatccgcggctatgtcagagataacggctgtagtgtggccgctgaatcaaccaattttactgttgatctgatggaaaacgcggcgaagcaatttaacaacattggcgcgacgactcctgtcgttccatttcgtattttgctgtcaccctgtggtaatgccgtttctgccgtaaaagttgggtttaccggcgttgcagatagccacaatgccaacctgcttgcacttgaaaatacggtgtcagcggctgcgggactgggaatacagcttctgaatgagcagcaaaatcaaataccccttaatgctccatcgtctgcgatttcgtggacgaccctgacgccgggtaaaccaaatacgctgaatttttacgcccggctaatggcgacacaggtgcctgtcactgcggggcatatcaatgctacggctaccttcactcttgaatatcagtaa

SEQ ID NO: 581 - DNA, 639 bp, Shigella flexneri 2a str. 2457T
atgaaaaagttaacagtggcggctttggcagtaacaactcttctttctggcagtgcctttgcgcatgaagcaggcgaattttttatgcgtgcaggttctgcaaccgtacgtccaacagaaggtgctggtggtacgttaggaagtctgggtggattcagcgtgaccaataacactcaactgggcttgacgtttacttatatggcgaccgacaacattggtgtggaattactggcagcgacgccgttccgccataaaatcggcacccgggcgaccggcgatattgcaaccgttcaccatctgccgccaacactgatggcgcagtggtattttggtgatgccagcagcaaattccgtccttacgttggggccggtattaactacaccaccttctttgataatggatttaacgatcatggcaaagaggcggggctttccgatctcagtctgaaagattcctggggagctgccgggcaggtgggggttgattatctgattaaccgtgactggttggttaacatgtcagtgtggtacatggatatcgataccaccgccaattataagctaggcggtgcacagcaacacgatagcgtacgcctcgatccgtgggtgtttatgttctcagcaggatatcgtttttaa

SEQ ID NO: 582 - DNA, 780 bp, Shigella flexneri 2a str. 2457T
ttgttttttaagcgaggaaagattttgagtgcgggacgcctgaataaaaaatctctgggtatcgtgatgtttttatcggttggactgctattggcgggctgttcgggtagcaaatcatccgatacaggaacgtattccggctccgtttacaccgtgaaacggggggatacgctatatcgtatttcgcgcaccacgggaaccagcgtaaaagagctggcgcgactgaacggcatttcccccccttacaccattgaagttggtcagaaactaaaactgggtggggcgaaaagtagcagtagtacacgtaaatcaaccgccaaatcaacgactaaaaccgcatcggttacaccgtcatcagcggtaccgaaatcttcctggccgccagtagggcaacgttgttggttatggccaacgacagggaaagttatcatgccgtattcgacagcagatggcggcaataaagggattgatatctcagctccacggggtacacctatttacgccgcgggtgcaggaaaggtggtgtatgtgggcaaccagctgcgtggctacggtaatctcatcatgattaaacacagtgaagattacattacggcttacgcccataatgacacgatgctggtaaataatgggcaaagcgtgaaggctgggcaaaaaatcgccactatggggagcacggatgcggcatctgttcgcctgcatttccagattcgttaccgtgcaacggcaattgatccgctacgttacttgccgccgcagggcagcaagccaaaatgctga

SEQ ID NO: 583 - DNA, 1653 bp, Shigella flexneri 2a str. 2457T
atggcacaagtcattaataccaacagcctctcgctgatcactcaaaataatatcaacaagaaccagtctgcgctgtcgagttctatcgagcgtctgtcttctggcttgcgtattaacagcgcgaaggatgacgccgcgggtcaggcgattgctaaccgttttacttctaacattaaaggcctgactcaggctgcacgtaacgccaacgacggtatttctgttgcacagaccactgaaggcgcgctgtccgaaatcaacaacaacttacagcgtatccgtgagctgacggttcaggcttctaccgggactaactctgattcggatctggactccattcaggacgaaatcaaatcccgtctcgacgaaattgaccgcgtatccggtcagacccagttcaacggcgtgaacgtactggcaaaagacggttcgatgaaaattcaggttggtgcgaatgacggccagactatcactattgatctgaagaaaattgactctgatacgctggggctgaatgggtttaatgtgaatggtggcggggctgtggctaatactgctgcatctaaagctgacttggtagctgctaatgcaacagtggtcggcaacaaatatactgtgagtgcgggttacgatgctgctaaagcgtctgatttgctggctggagttagtgatggtgatactgttcaggcaaccattaataacggcttcggaacggcggctagtgcaacgaattacaagtatgacagtgcaagtaagtcatactcttttgataccacaacggcttcagctgccgatgttcagaaatatttgaccccgggagttggtgataccgctaagggcactattactatcgatggttctgcacaggatgttcagatcagcagtgatggtaaaattacggcaagcaatggagataaactctacattgatacaactgggcgcttaacgaaaaacggctctggtgcttctttgactgaggctagtctgtccacacttgcagccaataataccaaagcgacaaccattgacattggcggtacctctatctcctttaccggtaatagtactacgccggacactattacttattcagtaacaggtgcaaaagttgatcaggcagctttcgataaagctgtatcaacctcgggaaacaatgttgatttcactactgcaggttatagcgtcaacggcacaactggcgctgtaacaaaaggtgttgattcggtttatgttgataacaacgaggcgttgaccacatctgatactgtagatttttacctacaggatgatggttcagtgactaacggcagcggtaaggcagtttataaagatgctgatggtaaattgacgacagatgctgaaacaaaagcagctacgacagccgatcccctgaaagctctggatgaagccatcagctccatcgacaaattccgctcctccctgggtgcggtgcaaaaccgtttggattccgcagtcaccaacctgaacaacaccactaccaacctgtctgaagcgcagtcccgtattcaggacgccgactatgcgaccgaagtgtccaacatgtcgaaagcgcagattatccagcaggccggtaactccgtgctggcaaaagccaaccaggtaccgcagcaggttctgtctctgctgcagggttaa

SEQ ID NO: 584 - DNA, 516 bp, Shigella flexneri 2a str. 2457T
atgaaaaaaattgcatgtctttcagcactggccgcagttctggctttcaccgcaggtacttccgtagctgcgacttctaccgtaactggcggttacgcacagagcgacgctcagggccaaatgaacaaaatgggcggtttcaacctgaaataccgctatgaagaagacaacagcccgctgggtgtgatcggttctttcacttacaccgagaaaagccgtactgcaagctctggtgactacaacaaaaaccagtactacggcatcactgctggtccggcttaccgcattaacgactgggcaagcatctacggtgtagtgggtgtgggttatggtaaattccagaccactgaatacccgacctacaaacacgacaccagcgactacggtttctcctacggtgctggtctgcagttcaacccgatggaaaacgttgctctggacttctcttacgagcagagccgtattcgtagcgttgacgtaggcacctggattgccggtgttggttaccgcttctaa

SEQ ID NO: 585 - DNA, 573 bp, Shigella flexneri 2a str. 2457T
atgaagcgtaatattataggcggtgcattcactctggcatctctaatgctggccgggcatgcactggcagaagatggtgttgttaacttcgtcggtgaaattgtcgacactacttgtgaagttacctccgatacagccgatcaaattgtcccactgggtaaagtcagtaaaaatgcattttcaggtgtaggtagtctggcgtcgccacagaagttcagtattaaacttgaaaattgcccggcaacgtacactcaagcagccgttcgttttgatggtacagaagcgcctggcggcgacggcgacctgaaagtgggtacgccgcttacagcaggcaaccctggtgattttaccggtacaggacaagcgattgcggcaaccggcgttggtattcgtatttttaaccagtccgataattcgcaggttaaactttataacgactctgcttataccgctatcgatgctgaaggcaaggctgaaatgaagtttattgcacgctatgtggcaaccaatgcgaccgtaacggctggtacggcgaacgctgattcacaatttactgtcgaatataagaaataa

SEQ ID NO: 586 - DNA, 1056 bp, Shigella flexneri 2a str. 2457T
atgaaaaagagcactctggcattagtggtgatgggcattgtggcatctgcatctgtacaggctgcagaaatatataataaagacggtaataaactggatgtctatggcaaagttaaagccatgcattatatgagtgataacgccagtaaagatggcgaccagagttatatccgttttggttttaaaggtgaaactcaaattaacgatcaactgactggttatggtcggtgggaagcggagtttgccggaaataaagcggagagtgatactgcacagcaaaaaacgcgtctcgcttttgccgggttgaaatataaagatttgggttctttcgattatggtcgtaacctgggcgcgttgtatgacgtggaagcctggaccgatatgttcccggaatttggtggcgattcctcggcgcagaccgacaactttatgaccaaacgcgccagcggtctggcgacgtatcggaacaccgacttcttcggcgttatcgatggcctgaacttaaccctgcaatatcaagggaaaaacgaaaaccgcgacgttaaaaagcaaaacggcgatggcttcggcacgtcattgacatatgactttggcggcagcgatttcgccattagtggggcctataccaactcagatcgcaccaacgagcagaacctgcaaagccgtggcacaggcaagcgtgcagaagcatgggcaacaggtctgaaatacgatgccaataatatttatctggcaactttctattctgaaacacgcaaaatgacgccaataactggcggctttgccaataagacacagaactttgaagcggtcgctcaataccagtttgactttggtctgcgtccatcgctgggttatgtcttatcgaaagggaaagatattgagggcatcggtgatgaagatctggtcaattatatcgacgtcggtgctacgtattatttcaacaaaaatatgtcagcgtttgttgattataaaatcaaccaactggatagcgataataagctgaatattaataatgatgatactgtcgcggttgggatgacgtatcagttttaa

SEQ ID NO: 587 - DNA, 1089 bp, Shigella flexneri 2a str. 2457T
atgcgtaagcagtggctcgggatctgcatcgcggcaggaatgctcgcggcatgtacaagcgatgatggtcagcaacagacggtaagtgtaccgcagcctgcggtatgtaacggccccatagttgaaattagcggggcggacccgcgtttcgaaccactgaacgcgacggcaaatcaggattaccagcgcgacggtaaaagctacaaaatcgtgcaggatccgtctcgatttagccaggcgggactggcggcaatctatgatgccgaaccaggcagtaacctgacggcctctggcgaagctttcgatccgacaaagctgacggcggcccatccaacgcttccgatccccagctacgccagaatcactaacctggctaacgggcgaatgatcgtggtgcgcattaatgatcgcggcccttacggcaacgaccgcgttatttcgctttctcgcgcggcagctgaccgtcttaacacgtcaaacaacaccaaagttcgtatcgatccgattattgtcgcccaggatggttcgctttctggtcctggtatggcttgtaccacagtcgccaaacagacttacgccctgcctgcacctcccgatttaagcggtggcgcgggaacaagttcagtgtctggcccgcagggtgacattcttccggtcagtaattcgacgctaaaaagcgaagatccgaccggcgcgccggtaaccagtagcggtttcctcggcgctccaacgaccttagcgcctggtgtactggaaggcagcgaaccgacgcctgcgccacagcccgttgttacagcttcgtcgacaacgcctgcaacctcgcctgcaatggtgacaccgcaagccgcctcgcaaagcgccagcggcaactttatggtgcaagtcggggccgtaagcgatcaggctcgtgcgcaacagtaccaacagcaactgggacagaagttcggcgtccccggtcgcgtaactcaaaatggcgcggtctggcggatccagcttggcccattcgccagcaaagccgaagccagtaccttgcagcaacgtttgcaaaccgaagcccaattacagtcatttattactaccgcgcagtag

SEQ ID NO: 588 - DNA, 543 bp, Shigella flexneri 2a str. 2457T
atgaagaaaaaaacgatatatcagtgcgttattttgttctttagccttcttaacatccatgtcgggatggctgggcctgaacaagtcagtatgcatatttatgggaatgtggtcgatcagggctgtgatgtcgccaccaaaagtgcattacaaaatattcatattggtgattttaatatcagtgattttcaggccgcgaataccgtaagcactgctgctgatttgaatattgatatcaccggttgtgccgctggtattactggcgcggacgtcctttttagcggcgaggctgacacccttgcgccgacactgctcaaactaactgacacaggcggaagcggtggtatggcaacggggattgccgtgcaaattcttgatgcgcaaagtcagcaagaaatcccgctcaatcaggtccagcctcttacgcccttaaaagccggggataacacactcaaatatcaacttcgttataagtccacaaaggcgggagcaacgggcggtaatgcgacggcggttctctattttgatctggtttaccagtga

SEQ ID NO: 589 - DNA, 456 bp, Shigella flexneri 2a str. 2457T
atgaaaaacaaattgttatttatgatgttaacaatactgggtgcgcctgggattgcagccgcagcaggttatgatttagctaattcagaatataacttcgcggtaaatgaattgagtaagtcttcatttaatcaggcagccataattggtcaggctgggactaataatagtgctcagttacggcagggaggctcaaaacttttggcggttgttgcgcaagaaggtagtagcaatcgggcaaagattgaccagacaggagattataaccttgcatatattgatcaggcgggcagtgccaacgatgccagtatttcgcaaggtgcttatggtaatactgcgatgattatccagaaaggttctggtaataaagcaaatattacacagtatggtactcaaaaaacggcagttgtagtgcagagacagtcgcaaatggcaattcgcgtgacacaacgttaa

SEQ ID NO: 590 - DNA, 519 bp, Shigella flexneri 2a str. 2457T
gtgatgaaatttaaaaaatgtcttctgcctgtggcaatgttagcgtcattcactctggcaggatgccagtcaaatgctgacgatcatgccgccgatgtttatcaaaccgatcaactgaataccaaacaagaaactaaaaccgttaatattatttccattcttcccgcaaaagttgccgtagacaactcccaaaataaacggaacgcacaagccttcggcgcgcttattggcgcagtcgctggcggtgttatcggccacaacgtcggttctggcagcaattccggaacgacggcaggggcagttggcggcggagctgtaggcgcggcagcgggttctatggtgaatgataaaaccttagtggaaggtgtttctttaacatataaggaaggcaccaaagtgtatacctccacccaggagggtaaagagtgccagtttacgacaggtttagccgttgttattaccacaacgtataacgaaacgcgtattcagccaaataccaaatgtcctgaaaagagctaa

SEQ ID NO: 591 - DNA, 552 bp, Shigella flexneri 2a str. 2457T
atgcaaacgaaaaaaaatgaaatttgggtgggtatctttttattagcagcactgctggcggcgctgtttgtttgcctgaaggcggcgaacgtgacgtccatacgtactgaatcgacctacacgctttatgcgacgttcgataacattggcggcctgaaagcgcgctctccggtcagcattggtggtgttgttgtgggccgggtggcggatattacgctggacccgaaaacctatctgccgcgcgtaacgctggaaattgaacaacgttataaccacattcctgataccagttcgctgagcattcgtacttccggcctgctgggagaacaatatctggcattaaacgtcggttttgaagacccggaactggggactgctatcctgaaggatggcgatacaattcaggacaccaagtctgcgatggtgctggaagatctcattggtcagttcctttacggtagtaaaggcgatgacaataagaatagtggcgatgcgccagctgctgcgccaggtaataatgaaaccactgaacctgtgggtacaacgaaataa

SEQ ID NO: 592 - DNA, 1578 bp, Shigella flexneri 2a str. 2457T
atggcaccgttagccttttctgcacaatcattggctgaatcattaacggtggaacaacgccttgagttattagaaaaagcgttaagagaaacgcaaagcgaactcaaaaagtataaagatgaagagaagaaaaaatatacgccagcgacggtgaatcgtagcgtaagtacgaatgatcaagggtatgccgccaatccgttcccgaccagtagtgccgcaaaacctgatgctgtactggtcaaaaatgaagagaaaaatgccagtgagacaggctcgatttattcttccatgactctgaaagatttcagtaagtttgtgaaagatgaaattggctttagttacaacggctattaccgttctggttgggggaccgcctctcatggttcacctaaatcatgggcgattggttctctgggccgctttggtaacgaatactccggctggtttgatttgcagttaaaacaacgtgtctacaacgaaaacggcaaacgggttgatgccgttgtgatgatagatggtaacgttggtcagcagtactctaccggctggtttggcgataatgccggtggcgagaactttatgcagttctccgatatgtacgttaccaccaaaggtttcctgccctttgcgccagaggctgatttctgggtgggtaaacacggtgcgccgaaaattgaaatccagatgctggactggaaaacgcagcgtactgatgctgcagcgggtgtaggtctggaaaactggaaagtcggtccgggtaaaattgatatcgcgctggttcgcgaagatgtcgatgattacgatcgcagcctgcaaaacaaacagcagattaatacccatactattgatttacgctataaagatatcccgttatgggataaagcgaccttaatggtgagtggtcgttatgtcacggcaaacgaaagcgcatcggaaaaagataatcaggataataacgggtattatgactggaaagatacctggatgttcggcacatctttaacgcagaaatttgataaaggtggcttcaacgaattctccttcctggttgcgaataactctatcgccaggaactttggccgttatgctggcgcaagtccatttaccacctttaatggtcgttattatggtgatcacaccggcggaacagcagttcgtctgacctcgcagggcgaagcctatatcggcgatcattttattgtggctaacgcgattgtttactccttcggtaacaatatttatagctacgaaacaggcgcacactctgatttcgaatctattcgtgcggttgttcgcccggcctatatttgggaccaatataaccagacaggtgttgaactgggctatttcacccagcaaaacaaagatgcgaatagtaataaatttaatgagtctggttataaaaccacgctcttccatacctttaaagtcaataccagtatgttgacctcgcgtctggaaattcgtttctacgccacgtatatcaaagccctggaaaacgaactggatggcttcaccttcgaagacaataaagacgcccagtttgctgtcggtgcccaggctgaaatctggtggtaa

SEQ ID NO: 593 - DNA, 1296 bp, Streptococcus mutans UA159
atgaaaaaaagaattttatcagcagttttagtgagtggtgtaactcttagttctgcgacaacattatcagctgtaaaagctgatgactttgatgcgcagattgcgtcacaagattctaaaatcaacaacttgaccgcacaacagcaagcagcacaagcacaagttaatacgattcaaggacaagtaagtgctttacagacacaacaagctgaattacaagctgaaaatcaaagacttgaagctcagtctgctactttgggtcaacaaattcaaacactttcaagcaaaattgttgcacgtaatgaatctttgaagcaacaagctcgtagtgctcaaaaaagtaacgcagctaccagctatattaatgctatcattaattcaaaatcagtttctgatgctattaatcgtgtttcggctattcgtgaagttgtatctgctaatgaaaaaatgcttcaacaacaagagcaagataaagcagctgttgagcaaaagcaacaagaaaatcaagcagcaattaatactgttgcagctaatcaggagacaattgctcaaaatacaaatgctttaaatacacagcaagctcaattagaagcagcacaactaaacttgcaagctgaattgactactgcacaagatcaaaaagctactttagttgctcaaaaagcggcagcagaggaagctgcacgccaagcagcagcagcacaagcggcagcagaagctaaggccgcagcagaagcgaaagctttacaagaacaagcagcgcaagcacaagcagcagcaaataataatactcaagctacagatgtttctgaccaacaagcagcggcagctgataacactcaagcagcacaaacaggtgattcaactgagcagtcagcagcacaagcagtaaataattctgatcaagaaagtactacagcaacagaagcacaaccatcagcttctagtgcttcgacagctgctgtagcagctaatacttcttctgctaatacatatccagcagggcaatgtacttggggtgttaaatcattagctccttgggtaggaaactactggggtaatggtggacaatgggcagcaagtgcagcagcggcaggatatagagttggttctacaccttcagctggagctgtagctgtatggaatgatggcggttatggacacgttgcttatgttacaggtgttcaaggtggccaaattcaagttcaagaagctaactatgcaggtaaccaatctattggtaactaccgtggttggtttaatccaggtagtgtaagctatatctatccaaactaa

SEQ ID NO: 594 - DNA, 4689 bp, Streptococcus mutans UA159
atgaaagtcaaaaaaacttacggttttcgtaaaagtaaaattagtaaaacactgtgtggtgctgttctaggaacagtagcagcagtctctgtagcaggacaaaaggtttttgccgatgaaacgaccactactagtgatgtagatactaaagtagttggaacacaaactggaaatccagcgaccaatttgccagaggctcaagggagtgcgagtaaggaagctgaacaaagtcaaaaccaagctggagagacaaatggttcaataccagttgaagtacctaaaactgatcttgatcaagcagcaaaagatgctaagtctgctggtgtcaatgttgtccaagatgccgatgttaataaaggaactgttaaaacagctgaagaagcagtccaaaaagaaactgaaattaaagaagattacacaaaacaagctgaggatattaagaagacaacagatcaatataaatcggatgtagctgctcatgaggcagaagttgctaaaatcaaagctaaaaatcaggcaactaaagaacagtatgaaaaagatatggcagctcataaagccgaggttgaacgcattaatgctgcaaatgctgccagtaaaacagcttatgaagctaaattggctcaatatcaagcagatttagcagccgttcaaaaaaccaatgctgccaatcaagcagcctatcaaaaagcccttgctgcttatcaggctgaactgaaacgtgttcaggaagctaatgcagccgccaaagccgcttatgatactgctgtagcagcaaataatgctaaaaatacagaaattgccgctgccaatgaagaaattagaaaacgcaatgcaacggccaaagctgaatatgagactaagttagctcaatatcaagctgaactaaagcgtgttcaggaagctaatgccgcaaacgaagcagactatcaagctaaattgaccgcctatcaaacagagcttgctcgcgttcaaaaagccaatgcggatgctaaagcggcctatgaagcagctgtagcagcaaataatgccaaaaatgcggcactcacagctgaaaatactgcaattaagcaacgcaatgagaatgctaaggcgacttatgaagctgcactcaagcaatatgaggccgatttggcagcggtgaaaaaagctaatgccgcaaacgaagcagactatcaagctaaattgaccgcctatcaaacagagctcgctcgcgttcaaaaagccaatgcggatgctaaagcggcctatgaagcagctgtagcagcaaataatgccgcaaatgcagcgctcacagctgaaaatactgcaattaaaaagcgcaatgcggatgctaaagctgattacgaagcaaaacttgctaagtatcaagcagatcttgccaaatatcaaaaagatttagcagactatccagttaagttaaaggcatacgaagatgaacaagcttctattaaagctgcactggcagagcttgaaaaacataaaaatgaagacggaaacttaacagaaccatctgctcaaaatttggtctatgatcttgagccaaatgcgaacttatctttgacaacagatgggaagttccttaaggcttctgctgtggatgatgcttttagcaaaagcacttcaaaagcaaaatatgaccaaaaaattcttcaattagatgatctagatatcactaacttagaacaatctaatgatgttgcttcttctatggagctttatgggaattttggtgataaagctggctggtcaacgacagtaagcaataactcacaggttaaatggggatcggtacttttagagcgcggtcaaagcgcaacagctacatacactaacctgcagaattcttattacaatggtaaaaagatttctaaaattgtctacaagtatacagtggaccctaagtccaagtttcaaggtcaaaaggtttggttaggtatttttaccgatccaactttaggtgtttttgcttccgcttatacaggtcaagttgaaaaaaacacttctatttttattaaaaatgaattcactttctatgacgaagatggaaaaccaattaattttgataatgcccttctatcagtagcttctcttaaccgtgaaaataattctattgagatggccaaagattatacgggtaaatttgtcaaaatctctggatcatctatcggtgaaaagaatggcatgatttatgctacagatactctcaactttaggcagggtcaaggtggtgctcgttggaccatgtataccagagctagcgaaccgggatctggctgggatagttcagatgcgcctaactcttggtatggtgctggtgctatccgcatgtctggtcctaataacagtgtgactttgggtgctatctcatcaacacttgttgtgcctgctgatcctacaatggcaattgaaactggcaaaaaaccaaatatttggtattctttaaatggtaaaatccgtgcggttaatgttcctaaagttaccaaggaaaaacccacaccgccggttaaaccaacagctccaactaaaccaacttatgaaacagaaaagccattaaaaccggcaccagtagctccaaattatgaaaaggagccaacaccgccgacaaggacaccggatcaagcagagccaaacaaacccacaccgccgacctatgaaacagaaaagccgttggagccagcacctgttgagccaagctatgaagcagagccaacaccgccgacaaggacaccggatcaggcagagccaaataaacccacaccgccgacctatgaaacagaaaagccgttggagccagcacctgttgagccaagctatgaagcagagccaacgccaccgacaccaacaccagatcaaccagaaccaaacaaacctgttgagccaacttatgaggttattccaacaccgccgactgatcctgtttatcaagatcttccaacacctccatctgtaccaactgttcatttccattactttaaactagctgttcagccgcaggttaacaaagaaattagaaacaataacgatattaatattgacagaactttggtggctaaacaatctgttgttaagttccagctgaagacagcagatctccctgctggacgtgatgaaacaacttcctttgtcttggtagatcccctgccatctggttatcaatttaatcctgaagctacaaaagctgcaagccctggctttgatgtcacttatgataatgcaactaatacagtcaccttcaaggcaactgcagcaactttggctacgtttaatgctgatttgactaagtcagtggcaacgatttatccaacagtggtcggacaagttcttaatgatggcgcaacttataagaataatttcacgctcacagtcaatgatgcttatggcattaaatccaatgttgttcgggtgacaactcctggtaaaccaaatgatccagataatccaaataataattatattaaaccaactaaggttaataaaaacgaaaatggcgttgttattgatggtaaaacagttcttgccggttcaacgaattattatgagctaacttgggatttggatcaatataaaaacgaccgctcttcagcagataccattcaaaaaggattttactatgtagatgattatccagaagaagcgcttgaattgcgtcaggatttagtgaagattacagatgctaatggtaatgaagttactggtgttagtgtggataattatactaatcttgaagcagcccctcaagaaattagagatgttctttctaaggcaggaattagacctaaaggtgctttccaaattttccgtgccgataatccaagagaattttatgatacttatgtcaaaactggaattgatttgaagattgtatcaccaatggttgttaaaaaacaaatgggacaaacaggcggcagttatgaaaatcaagcttaccaaattgactttggtaatggttatgcatcaaatatcattatcaataatgttcctaagattaaccctaagaaagatgtgaccttaacacttgatccggctgatacaaataatgttgatggtcagactattccacttaatacagtctttaattaccgtttgattggtggcattatccctgcagatcactcagaagaactctttgaatacaatttttatgatgattatgatcaaacaggagatcactatactggtcagtataaagtttttgctaaggttgatatcacttttaaagacggttctattatcaagtcaggtgctgagttaactcagtatacgacagcggaagttgataccgctaaaggtgctatcacaattaagttcaaggaagcctttctgcgttctgtttcaattgattcagccttccaagctgaaagttatatccaaatgaaacgtattgcggttggtacttttgaaaatacttatattaatactgtcaatggggtaacttacagttcaaatacagtgaaaacaactactcctgaggatcctacagaccctactgatccgcaagatccatcatcaccgcggacttcaactgtaattaactacaaacctcaatcaactgcttatcaaccaagctctgttcaagaaacattaccaaatacgggagtaacaaacaatgcttatatgcctttacttggtattattggcttagttactagttttagtttgcttggcttaaaggctaagaaagattga

SEQ ID NO: 595 - DNA, 2505 bp, Streptococcus mutans UA159
atgttaacggaattaaaagcggttttaaaaaagcctatgctttggattacgatggtaggagtagcccttgtccctgccctatataatattatttttttgagttctatgtgggatccttatggcaaagtatctgatttacctgttgcagttgttaataaagataaaacggcaacttatgaaggaaagaagatgactatcggtaaagatatgactgataatatggtccgtaataaaagtttggactatcattttgttgatagcgaaaaagctcaaaagggacttgaaaaaggtgattactatatgatcattactttaccagaagatctttctcaaaatgcggctagtgttttaacagatgaacctaaaaagctaacgattccttaccaaacgtctaaaggacatagttttgttgcctccaaaatgagtgaaactgctgctaagactttaaaagagtctgtgtcgaaaaacattacaagttcttacaccaaatcactttttaagaatatgtcaaccctaaaaacaggtcttggcagtgcggctaatgcaagtcaaaaaatagcgactggttcaaaacagttagcaaatggcagtcaagtgatgactgataatctgaatttactttcaaattcaagtcaatcatttgctcaagggactaataccttatattcgggcttaacagcttatacgggaggtgtcggtcagctttctgcaggtttaaataatttaaacaatggtttgacagcttatacaaatggagttggtcagttagcaaatggcagcagccaactgagcaatcaatctcagaagcttctaggaggtgttgcgcaattagcgaatggttctgcttctattcaacaattggttaatgctagcagtcagttgaatcaaggacttattaagctgtcaacagcaacaggtctttctgaagaacaagttcaacagtttagctcattgattaatcagttgggaactttgaatcaaagtattcaaaattacagtgataatgggacagcaacgactgcaaatagtcctgatcttagtacgtatttatctgccattacaacagcagctcaagcaattgttaattcaggaaatacgtctcagcaaacaacaactaatcagtccaatgcattggctgcagtccaagctacaggtgcttatcaaagattatccgctgaggatcaatcagagatcgctgcagctttggccaacactggtagttcaacaacaactacaggtgctgatgcaaacgcagtgtcacaagcccaagctatcctaaacaatgtccaaagtattcaaagtgccttatctactttacagacaacaactgctaatacaccaacaagcccatcagccagcttgactcaaattaaaaatacagctaattctgtattacctagtgcggcaacttccttgacaaccttgtcaagtggtttgacacaagcaaaaacagctcttgattcgcaagtagtccctgtcagcacagcccttgctaatggtacggctcaattaggctctactttttcaacaggcgccaattccttgatgacaggagtaggccaatacactaatgcagttgatattcttaatgcaggagctaatactttggctgctaaaaataaccagttaacagatggtacaagtcaattggtaaatggtgccaatcaattaaatagcaactctggacaattaacgaaagggactgcacagttagcaaatggtgctaatcaaatagagacaggagctggcaaattggctgcaggtggagaaagtttaacggcgggcttgacaactttgtcaagtggtagtggtgaactgtcgaaagcattgtcaactgctaaaaataaattatcattagtagcagttgacaatgataatgctaagactttgtcaagtcctgtcactatcaagcatacagataaagataatgtcaaaacaaatggtgttggaatggctccttatatgatgtcagcagctttaatggtaatggcaatttcaaccaatactatctttagagtagcactttctggtaagcaagctaaaaccctacgagaatggatagatcaaaagttagcagtcaatggcttgattgctgttactggagctattattctctattttggtgttcatattattggtttatcagctaattttgaactaaaaactttaggattaattattcttaccagtatcacttttatggtcttagtgacaactttggtaacttggcatgataaatttggctcttttgctgccttaattttacttttactacaattaggttccagtgcaggaacctatcccttagccgttacagataagtttttccaagttgtcaatccttatttaccaatgagttattcggtttctggtttacgagaaaccatttctatggctggtacaattggtaatcaactactagcgctgagtttatttttccttacttttgctgctttaggattgttaatcgctcgaaggaggattaggtctgtcaaagtagcctaa

SEQ ID NO: 596 - DNA, 2079 bp, Streptococcus mutans UA159
atggtatcccaaaaaaataaatctaaaaagggtcaatctaaaacgtttaccttaatttcaaatagaattaatctcctattttttttgattgtcgctttgtttactgttttgcttttgaggttagctcagatgcagctttatgatgcaaagttttacaaatctaaattgacagagtcaacaacatatactataaaaacctccagccctcgcggacaaatttatgacgctaaaggggtggctttagttgaaaacgaggttaaagaggttgttgcctttacaagaagcaataccatgactgccaaggatattaaagcaaatgcaaaaaagttagcagatatggtgactttaactgaatctaaggtaaccaaacgtcagaaaaaagattactatctggcagatccaaaaaattatcaaaaaatcgttaaaaaattaccaaataataaaaaatatgataactttggaaataacctaacggaatcgaagatctatgcaaatgctgttaaagcagttccaaacagtgctattgattattctgaagatgagaaaaaaatcattcatattttcagccagatgaatgcaacctctgtttttaatacagcttcgttaacaacaggagatttaacagctgagcaaattgcagtattggctacaagcaaatcagatttaaagggaatttctgttaagactgactgggaacgtaaaacagataaaaattccattacttctattatcggtaaagtttccagtcaaaaaaccggtctgcctgctgaagaagccaataactatgttaaaaaaggttattctctgaatgaccgcgttggaacatcttatcttgaaaagcaatatgaaaacgatttgcaaggtagtcgtactgttcaagcaatcaaggttaacaaagaaggtaaaattatcagtgataagaccactgccaaagggactaaaggaaaaaatctgaagttgacccttgatcttgaatttcaaaaaggtgttgaacaaattcttaaccaatattttaattctgaattagcatctggaaataccaagtattctgaaggcgtttatgctgttgttcttaacccgaacacaggtgcagttctttctatggctggtttggaacacgaccttaaaacgggcgaagtatcttctaatgctcttggagcggttactgaagtctttactccgggttccgttgttaaaggagcgactttgacagctggttgggaaaacggtgtcttatcaggcaatcaagtactcaatgaccagcctattcaatttgcgggttcaagccctattaactcttggtttaccaatggatcaactcctcttacagcaagtcaatccttagagtattcttctaatacttatatggttcaattggctttaaaattaatgggacaagattatcatagtggtatgaccttatcaacagatggctataaggaagctatggagaaattaagagctacttatgctcaatatggtttgggtgtctcaacaggaattgaccttccgggagagtcaaagggctatacgccagaacattatgatccttctaatgttttaacagaatcatttgggcagtttgataactatacggctatgcagctggcacaatatgctgcagctgtcgcaaatggtggtaaacgtattgctccccatttggttgaaggtatctatgataataataaaacaggcggtttaggaaatcttgttcaatctattgacaccaaggttttaaataatgtttctatctctagcgatgacatggggattatcaaggaaggtttctataatgttgttaacggtggtagttatgcaacagggaagactcttgcaaaaggggcaagtgttcccatttcggcaaaaacagggacagccgaagcttacgtgacaggagatgatggtaaatctgtttatacatccaatttaaacgttgttgcttatgcaccaagcagcaatcctcaaattgctgtagctgttgtcttgccacatgagacagaccttcatggaaccactagtcatgctattacgagagatatcatcaatctttatcaaaagatgtatccaatgaatcagtga

SEQ ID NO: 597 - DNA, 2124 bp, Streptococcus mutans UA159
atgacagttctaaaatatggactaggtattctcttaagcgctattattttagccattataattggaggtcttctgtttacctattatgtcagcagtactcctaaactatcagaagctaaacttaaagctactaattctagtttggtttatgatagcaataataatctgattgctgatttaggtgctgaaaagcgcgaaagtatttcttcagacagtattccaatgaagttagtaaatgccgttacctctattgaagatcaccgtttctttaaacatcgtggtgtcgacatttatcgtattattggtgcagcttggagtaatttacttcataaatcaactcaagggggatccactcttgatcagcagcttatcaagctggcctatttctctactaaagagtctgatcagaccttaaaacgtaaagctcaagaagtttggctgtctctacaaatggagaaaaaatacacgaaagaagagattctaactttttatgtcaataaggtttacatgggtaatgggaattacggaatgcgcactgctgcaaagtcttattatggcaaggatcttaaagacttatcaattgcccagctagcgacactcgcaggtattccgcaagcaccgacacaatatgatccttacgctcagccaaaggcagctacaagcagacgtaataccgttttgtcacagatgtataaacataaaaaaattacaaaacgagaatatgatgctgcagtagcaacaccaatttctgatggcctgcaagaactgaaacgctcctctagttatccaaaatatatggataattatctgaaacaggttatttcagaggtgaaaaaacgtactggtcaagatatcttttcagcaggcatgaaggtttatacaaatgttaatgccgatgcacagcaatatctctggaacatttataatacagatgaatatattgcttatcctgatgataatttccaagttgcttctactgttatggatgttactaatggtaaagttattgcacagcttggcggacgccatcaagataccaatgtttcttttggtaccaatcaggctgtcttaactgatcgtgactggggatcaaccatgaaacctatttcagcatatggccctgctcttgaaagcgaagcttttacgacaactgcacagatgctaaatgactcggtctattattatccaggtacaacaacacaagtctatgactgggatcatcgttataatggttggatgactatccaaacggctatccaacaatctcgtaatgtccctgctgtcagagctattgatgccgctggattagatactgccaaaggtttcttaagcggtctcggtattgattatcctgagatgcgttattcaaacgccatttcaagtaatacaagtagttcagaacaaaagtatggtgccagcagtgaaaaaatggccgccgcttatgctgctttttctaatggtggaacttattatgaaccacaatacgtcaataaaatagaatttaaggatggaacatcagagacctatgatgctaaaggcaatcgtgcgatgaaagaaacgacagcctacatgatgacagatatgttaaaaacagtattaacatatggtactggtactgaggctgctattcctggtctttatcaagcaggtaaaacaggaacatccaactatgatgacaatgaattggtagagatgtctgaaaaacttggtattaatccttatggacttggtactattgctccagatgaaaactttgttggttatacacctcagtattcaatggctgtttggacaggatataaaaatcgcttaatgcctgtttacggagacagtatgaaaattgctgcgcaagtctatcgtactatgatggcttatctttctagctcaggtaattctgattggaccatgcctgacggtctctatcgcagcggtggttatctttacctaaatggttcaagtgggtcaaatagtaggtatggtgcagctcctgcaacttcatcgtcatcttcttcatcatcttcttctgattcaaacaataacgatcaaaataataatcaaactacagaagcgtctagtgactcatcttcatcaagttctgatgctacgacatcttctaatccataa

SEQ ID NO: 598 - DNA, 1752 bp, Streptococcus mutans UA159
atgaaatcgaaaactgctaaaattactttgctaagcagccttgctttggcggcttttggagcaacgaatgtttttgcagatgaagcatcaactcaattaaattctgatactgttgcagcacctactgctgatacacaagcatcagaaccggctgcaacagaaaaagaacagtctcctgttgtagctgttgtcgaaagtcacacacaaggaaatacaacaacgacaacatctcaagttacttctaaagaattggaagatgctaaggctaatgctaatcaggaaggtttagaagtcactgaaactgaagctcaaaaacagccttcggtagaagctgcagatgcagataacaaagcacaggcacaaacaattaatacagcggtagctgattatcaaaaggcaaaagctgaatttcctcaaaaacaagaacaatataataaagattttgaaaagtatcagtctgatgtcaaggagtatgaagctcaaaaggcagcttacgagcaatataaaaaagaagttgcacaaggtttggcatctgggcgtgttgaaaaagcccaaggacttgtgtttattaatgaacctgaggcaaaactttctattgagggtgttaatcagtacctaacaaaagaagcacgtcaaaaacatgcaactgaagatattcttcagcaatataatactgataattatacagcttctgattttacccaagcaaatccatatgatccaaaagaagatacttggttcaaaatgaaagtgggagatcagatttcagttacctacgataatatcgttaattcaaaatataatgataaaaagattagtaaggtaaagattaattatactctcaatagttcaacgaataatgaaggcagtgcactggtcaatttgttccatgatccaactaagacaattttcattggtgcacagacatctaatgctggcagaaatgataaaatcagtgtgacgatgcaaattattttttatgatgaaaatggcaatgaaatcgatttaagcggcaataatgccattatgagtctctcatcgttaaaccattggacgactaagtatggcgatcatgtggaaaaagtaaaccttggggataatgaattcgttaaaataccgggctcatctgttgacttacatggcaatgaaatctattcggctaaggacaaccaatataaagctaatggtgcaacctttaatggtgatggagcagatggctgggatgctgtcaatgctgatggaacgccacgtgctgcgacggcttattatggtgcaggtgctatgacttacaagggagaacccttcacctttactgttggtggtaatgatcaaaacttaccaacaaccatttggtttgcgactaattcagctgtagctgtgcctaaagatccgggagctaaaccaacaccgccagaaaaaccagagttgaaaaaacctactgtgacttggcataaaaatcttgttgttgaaactaaaactgaggaagttcctccagtgacaccaccaacaactcctgatgaaccaacgccagaaaagccaaaaacaccagaggatcctcaatcacctgtcgtagctaagtcagtaagctttagaacggcaagaaaaggagaaatgcgtgttagagagcgtgattatcaaccgactcttccacatgctggggctgctaaacaaaatggtttagctactcttggtgctatttcaactgcatttgctgcggctactttgattgcagctagaaaaaaagaaaactag

SEQ ID NO: 599 - DNA, 1524 bp, Streptococcus mutans UA159
atggaacagaagatttttagcaaacgaaaaagtaagattgctgggctttgtggagctattttaacgactacagttgttgcccttgcgtcaggtactgtaatcgaggctgatgagacaatagaacagcctgtcgcagctgagactgtctcgcaagctgatggggacaatcccgaacaaacaacaagcgttcaacaagaaactgctcctcaacaaacgaaaacttctcaaagctcagacgcaaccgtagatagtgaagagtcagcaacttccccatctgatgaacagaccgtaagtcaaaatgattcaaactcatcatctcaaattgatcaaacgatagctgatacgaatcgctctgactctgatcatatttcaaaaacatcagccgctacaactgaagatcaagaagagaaagttaattctgcaaaagcacaaactgctgccgcaaccaacaatcaagacactcgttatagtgcgaaagatgcttatggcaattccaattttaacaagacattaactgaatttggaaaaaatgctaatgttgctgatgtaacctataatggcgtgagggatgaatatattgtagttaacgatcctagtgctccttacgttcctaatgcaaacgaaattgcaaaatacttaaaggaatatttaacagaactccgcaacatcaataatattgctattcctgtgccttctgttgatcaggttatgcaaaaatacgcacaagatcgggctaacgaagaagccaatgaaaaaaacggcttggatcatgatactaatttacctatccctaataatttaacttgggttgccgaagatggacatttggatatggatagcagcattcaatccaaaagtcaagaaggctatacacttgcttctgataaagcaaccgcctactatctagcgcttaactggttttctgactattttaatatttacgatgaccccaacgatggcctcaaatcgtttggacacgctgtcagtattttgtcagacgggggaactggaatgggcttaggtcttgcttcaggtcaagataatgaaaagggaatgtggtacgcacaattggaatttggtggtaacgataacgaagataataccaacgatttttcatctttaaaaaacggcaagggagaatgggtattatattataaaggaagtcctgttaagtttcttcctaacactaccttttggtatgtaaaaaaaggcacttcccctgatgcagcttctactcctcacaacagtgataaaccttcattccagtcatctaaagatcttgaccctaatttcaaggccgataatagattccaagaaggaaaggaagcctctgttcatcaggctattcctgcaacatttaaatctcatcgcgatgaagttggtaataaagaccaaaattctctttctgctcaactacctgatacaggagttcaaaaaaataatcaattagccttgatagctttaggaacaggcttgattttactttccggacttcttctttcaaaaagaaaatccttaaaataa

SEQ ID NO: 600 - DNA, 2181 bp, Streptococcus mutans UA159
atgacatttgaaaagcaaaaacactttagtttacgtaaactaaaatttggtttagtttcagttgcgatcatagctttcttatttgctgtaacaaagactgcagaagctgacgagacagtgataactgaacaaaggcaaacaagtaagattaacgctagttctcaaaaagtggagaatcagacttcaaatcaggtggaagcaaaaacggatagtgcaaacaaggatcctcaagaaaaaacaggaagtgttgcaactgatgccccttcaatgaattcagctaataatatgagtcagtctgacaaacaaaatactgttaatgaaatatcttcagatagtcagcaaacaaaaacagatgaacaaactgatttaccgcaaaacagctttaaacaacaatctgctcatgttaaaatgactactgaagcagagaagaccccatcacattcgattaatacctttgttaatgatggtaatggtaattggtattaccttggtgctgatggtagaaatgttacaggcagtcatacgattggtggcaagactatgtattttgctcaagatggtaagcaagttaaaggtgcttttgctcaagattcggatggaaataaacattattatgatagagatagtggtgagatgtggaccaatcgctttgtcaatgatcaaggcaattggtattatcttaataatgatggtgtccctgtcaccggtagtattactgtcaatggtcagtctctgtattttaattcggatggtagtcaggttaaagggaattttgttgaagaagatggatctttgcgttattatgataaaaattctggagatttactgagaaagacaagccgaaccattaatggtgttaactaccaatttgataatgatggaaatgcaagggcgattgacaaaattgaggttgttaagaccagtcttgtagttgatagttatgaatttggtccttctgtttcaaagattattcttgagttcaatcataaggtaactcctgctgttgttcatgctggtgcaatggtaacaactgctggagttcaaagaaaaattcttaattcttatgtctctaatgcttcaggacatgtggtttactttgatagtagccattatgtgacacttgaattagatattccttatgatccaaatgatagcagccgaaatgcatcaccttttatttttgactcagcagcctttcgtaataactgggtcaacagttatactgtcaaagtagataatttgcaggtgcaagcagatggttctaatagcagtcaaattatcagttcagagcaagatgctatcaataatcgtttcttgcctacaacggatcgtttctcagaacgtggtagttatggtaattttaattatgccgcctatcaaccagaagcagctattggcggtgagaagaatccattgattgtctggttgcatggtataggagaagtaggcactgatattaatattccgcttctagccagcaatgtggctcgtttaacggaagatcctattcaaagccatttcacttctacaggtagtggtggtcaaaagggagcctatgtgctagttcctcaaagttcaattccttggtctcaaaatcaaacagctagcttaatggcgctcattaaagcctatgtagcaagccatccagacatcgatagccgacgcatttatttggcaggtgtttctaatggtggcggtatgactctggatatgggagtcgcttatcctaactattttgcagccttagttcctattgctgcttcctatagtaatcaattaacagataatcagattaccgctgctgctttgaaagctctgaaaggtcaaccaatgtggttgattcatacacgaactgataaaacaatatctgcagatagtagtgttctaccattctataaagagttacttcaagctggcgcacaaaataaatggctttcctattatgaaactaatgttggtaaacatcactctggagtcacttataacggtcactggtcttggatttatttcttgaatgatcaagtaactggcactcaaaatactgataacgccaagaattggtctggactttctggcatggttgcgaccaatccaacctatggtggtgatgctaaggctactgtcaatggcagaacttatagtaatgtctttgattggctaaatggtcagcgaagaaggtaa

SEQ ID NO: 601 - DNA, 2574 bp, Streptococcus mutans UA159
atgaaaatttttataaaaaaacaccaacaaagtattctttactatagtcttagttttctgctaccaagttttataatgtttctcgttctattctccaaaaatatttattgggggagtagcacaactattttagctagtgatggttttcatcaatatgtgatttttgatgctctttttcgtaatattctccatggaacggatagtttgttttactcttttaaggctgggcttggttttaatatttttgctctgacaagttattacttgggaagttttttaacaccttttacttacttttttaatgtaaaaaatatggcagatgctttttatctcttcactttaatcaaatttggtctaataggtttatctgctttttacagtcttgggcaaatttatactaaaatctctaaatcactcgttttgatgctgtcaacatcttatgctttaatgagctttactagcagtcagttagaattaaacaattggttagatgtttttatcctgctaccacttattatgcttggtttacagcgtttagtagaaaaaagggggatttttctttattttctaactcttacttgtttatttattcaaaattactattttggtttcatgacagctattttcttaactctttggttttttacgcaagtctcgtgggatattagaaacagaatgaaacgattaagtgattttgtgctcgtatcaatctttgcaacgctgacaagtgcttttatgctgcttccaacatttcttgatttaaagagccatggtgaagtattaacagaacaaattagtctattttcatcagacatttggtatttcgatttttttgctaaaagtcttcttggtagttatgatacgacaaaatatggctctattccaacgatttatatcggtttacttcccttgatttttgccattacttttttctttgttaaatctataaaatggcaagttaaagtagcttattttcttttattggctattattattgcaagttttatctttcaaccacttgatttattttggcaaggaatgcattcacctaatatgtttttgcatcgttattcttgggctttctccttagttattgtcataatggcagctgaaacgttaactcggataaaggatataaaattgaaaaatttttatccagcctttaccttcttgggagtaggacttttagcaacttttttattcaaggactattataattatctgacacaagttaattttatattaacaactatctttttagttagttattttattattctttttactttttttaatcaattagtttcttataaagttattatttcctttacacttatctttacaagttttgaaatagctttaaatactttttatcaaattgaaggtattcaaactgactggaatttcccttcaagagaggtttatgaagataatgtaaaggaaattgacaactatgttaagaaaactaaaaaagataacttagaattttttcgaacagaaaaacaaattccccaaacttacaatgatggtatgaaatttaattataatagcatttctcagttctcatctgtcaaaaataacttatcagcacaattattgaattctctaggctactattcacaaggaaatcattctaccattagttatcctaataatactattttgatggatagtcttttttcaattaaatacaatattaataatcaaaatcctcataaatttggattccatttaaaacagaaaaacaataagctgcaactttacaaaaacttctattctcttcctttagcacttatgtcaaatcatatttacaaagatgtcaagtttgactcttatccccttgataatcaacaaaaatttgttaatgaattgacagatctaaatcttacacttttcaaagaaatccctattatttcaagtgtcggaatgcaagttttagataatcgtgttactattaatggttcaaaaggaaataaggcacaagtttactatactgtaaagtgtcctgcaaatagtcaactttatatcagccttcctaacttgacagttaataataaagacgaaaatgtctttataacaactaacaagcacacaagttcttatatcatagacgaaagttattatctttttaatttaggaaattataaaaaaactcaaacattaatatttaagcttagttttccaaaaaataaaacggttagttatgatttaccacatatttatgctctcgatttaactgcctatcaaaaaagtataaagcaattaaaaagtcaaactgttaaaacaacaactaagaaaaataaaatttttactacctatgttgccaaaaagagaacttccttgatttacactttaccatatgataaaggttggtttgctaaacaaaatggaaaagcaattaaaatatctaaagcacaaaatggactaatgaaaattgatgtttctaaaggtagtgggaagattataatgacttttgtgccccaaggactatatcaaggaattcttcttacctgtctaggtatctttctctttgtattttaccaactttattacaaaaaatttaatttaaaataa

SEQ ID NO: 602 - DNA, 804 bp, Streptococcus mutans UA159
atgaaattgaaacatattttaagaattggagcggttgcttttgcctcaattcttttgttaactgcttgcggatcaaaaacatctaaaaaaacagtaacccttgcgactgttggaacaacaaatccattttcttatgagaaaaagggaaaattgacgggatatgatatcgaagttgctaaggaagttttcaaagcttctgataaatacgatgtcaaatatcaaaaaacagagtggaccagcattttctctggtctagatagtgacaaatatcaaatcggagctaacaatatcagttatactaaagagcgtgccaataaatatctttattctaatccaacggcttccaatccattggtattagtggttccaaaagatagtgatattaagtcttataacgatattgctgggcatagcactcaagttgttcaaggaaatacaacagtgtctatgctgcagaaattcaataaaaaccatgaaaacaatcaagttaaactaaactttaccagtgaagatcttgcgcatcaaatccggaatgtcagtgatggtaagtatgattttaaaatttttgaaaaaatttcagcagaaacgatcatcaaagagcaaggacttgataatttgaaagttattgatcttccttcagaccaaaaaccatatgtttactttatttttgcgcaagaccaaaaagacttacaaaagtttgtcaataaacgtctcaaaaaactttacgagaatggtacacttgaaaaattatcgaaaaaataccttggaggaagctatcttccagataaaaaagatatgaaataa

SEQ ID NO: 603 - DNA, 1059 bp, Streptococcus mutans UA159
atgcgatttcttgtctttctcatcgcattttttgctgctttctataaatttatcgagactgaacggattgattcaaatacagttgctgtaaaccctgattcgctcattttaaagcgatttttaaaaacaaatcaattaaatgggatcatgattgtgacggggccagatggtaaggctcaagtattttcaaatcaaagcaaggtagatggcagtcctgtttcaattaaggattattttcctcttgcttctttacaaaaattgataacaggggtggctatccaacaattaattgataaaggaaaactgtctttaaacacacctttaagcaaatattatcctcaaattgaaaatagtgaaaatatcacgatacaaaatttacttacccacacaagcggtttggcagatcgaaaagaagttcctcagcaagtgctgacaactcaagagcagcaattggatttttcattgaccaattatcgcgtaacttatcgaaaaaaatggaagtatgctaacattaattatgctttgctagctggcattatcagtcaaattagcggtcaaaattatgcgacttatgttcgtcaacacttcttaacagctggtaaggggtggcattttaaaaagtatattcaaataaaagataagtccaagttagctgccttgtcagtgatggatcaaagtacgacttgggataagctgtcaaaagaagtgacatctacctttggagctggtgattatgcttctaggccagtggattattggaaatttatgatggcttttattaatgaccaatttgttcctgtcagcgaataccaacgttctatgaaaatgacttctaagagctattatggcggcctctatatcagccaaaagatgctgcatgcaaatggtggtggctttgatacttactcttgttttgcttattcaaatcctaaaaccaaacaggtcatggttttgtttatcacaaacggtaagtataaacgggtcaaatccttagcagctaaagcctttaaactatatgcagattcgtatgcgctgaggaaaaatgaaacgtcaaaataa

SEQ ID NO: 604 - DNA, 1173 bp, Streptococcus mutans UA159
atgaagaaaaaaatagctctagcagctctttcttttgtcagtgcagctgttcttgcagcttgcagctcagcacctggtggttcatcagatgcagctggtaataaaattggagatactgtaaaaattggttacaatcttgaattatcaggagatgtagccgcttatggacaagctgaaaagaacggtgctaaccttgctgttgaagagattaataaggcaggcggcattgatggcaaaaagattaaagttatctcaaaagataataaatctgataacggtgaagcatcaacaatctcaactaatcttgctacccaaagtaaagtaaatgctatcttgggaccagcaacatctggtgctacagcggctgctgctcccaatgccaacgatgctgcagtaccactcgtaacgccttctggaacacaagataatttgacctattcaaaaggcaaagttcaagattacatcttccgtacaacttttcaagatagcttccaaggaaagatcattgccaaatatgcaacagataatttgaaagctaaaaaagtagcgctttactatgataagtcaagtgattacgcccaaggtattgctgatgcattcaaaaaagcatataaagggaagattactgttgaagatacctttcaagctaaagaccaagatttccaagcagctctgaccaagtttaaaaataaagactttgatgccattgtgataccaggttattatactgaaactggtctgattacaaagcaagcacgtgatatggggcttacccagcctatcttaggacctgatggttttaatgatgaaaaatatgttgaaggtgctggtgcagccaataccaataatgttcattatgtatctggttactcaacaaaagttgctttaacaaataaggctgaaaaattcctgaaagattataaggctaagtatggtgaagagccaaatatgtttgccgctcttgcttatgattccgtttatatgattgctgatgctgcaaaagatgccaaaacatctaaggatattgcaacaaacctagctaaattgaaaaactttaaaggtgtgacaggtaaaatgacaattgataagaaacataaccctgttaaatcagccgttatggttggtcttaaagatggtaaagaagacacagctactgctgttgaagcaaaataa

SEQ ID NO: 605 - DNA, 921 bp, Streptococcus mutans UA159
atgaagaaattaagcttattattactagtttgtttatctttattaggcttatttgcctgtacttctaaaaaaacagccgacaaaaaattgactgttgtggctaccaattctattattgctgatattactaagaatatcgctggtaataaggttgtcttacatagtatcgttcctgttggtcgagatcctcacgaatatgagcctcttcctgaagatgttaaaaagacctctcaggctgatgtcattttttataatgggattaatcttgaaaatggaggcaatgcttggtttaccaaactagttaaaaatgctcataaaaagacagacaaggattattttgcagtgagcgatagtgttaagaccatttatttggaaaatgcaaaagaaaaaggaaaggaagatcctcatgcttggcttgaccttaaaaatggtattatttatgctaaaaatatcatgaaacgtctatctgaaaaagatcctaaaaacaagagttattatcagaaaaattttcaagcctacagcgccaaacttgaaaaactacacaaagtagccaaagaaaaaatcagtcgtatccctactgagaagaaaatgatcgtaactagtgaaggttgtttcaagtatttctctaaggcttacgatattccttctgcctatatatgggaaattaataccgaagaagagggaacaccaaatcaaattaaggctttagtgaaaaaattaaggaaaagtcgggtgtctgcgctttttgtagaaagcagtgttgatgatcgtccaatgaaaactgtttcaaaagatacaggtatcccaattgccgctaaaatttttacagattcagttgctaaaaaaggacaggctggagatagttactatgcgatgatgaagtggaatatagataaaattgcaaatggtctgtcacaatga

SEQ ID NO: 606 - DNA, 1098 bp, Streptococcus mutans UA159
atgtttgttcatactaagactaagaaaaaaagaaagtggcaaaggaaagtgtttctactgctgcttctttttttattgcctattgtgtcagtattggcttttattgtgttatttattggcggtggtacagctgagtctcatgatgtggaagcgacgacagggggcgttaagctttcagctaagcaatttgcagataagacaaagttaggaatttcagaagaggaagctaaaaatgccttagcttttgcggataggttgatgtctcgtcatcattttacagctcaagcaactgctggagtattggctgttggctttcgtgaaagtggctttgatgtcaaagcagttaataattctggtggtgtagctggctttttccaatggtctggctggggtagttctgttaatggtgatcgttggaaagtagctagtaaaagagagttaactctagaggttgaggtagatttgatgagcactgaactagatggtcgatatgctgatgttgtcaaaaaagttggttctgcgactgatgaaaaacaggctgctaaggattggtctcagtattatgaaggtgttgcggttagtgatggtcaaacgaaagctgataaaattgagagttgggcaacaactatttgtgaggctttaaagtctggtggtacaaattatgctaaagtgaataatacgggaacaagttctactgctatcccgcagggttgggaaaatattagtgcttttgatggccatgcttatgaaggtagtgaaaattatcctcaaggacaatgcacttggtatgtttataatcgtgctaaacagttgggtgttagcttcagtccttatatggggaatggcggtcagtggtatcaagtgcaaggctaccattctagtcatacacctaaagcacatacggctttatcttttgtcaatggtcaggcaggttctgatccaacttatggtcatgttgcttttgtagaggctgttaaagatgatgggagtattctaatcagtgagatgaacgtttatggtcaaccagctatgacggttgcctatcggacatttgatgctgaaactgctaaacaattttggtatgtagagggaaaataa

SEQ ID NO: 607 - DNA, 1362 bp, Streptococcus mutans UA159
atgaaaatgaaacgtaaactattaagcttggtttcagtccttactattttattgggagctttttgggtaacgaagattgtaaaagctgaccaagtcacaaattatacaaatacggcttctatcacaaaatcagatggtacagcactttctaatgatccatctaaggctgttaattattgggaaccactttctttcagtaattctattactttcccagatgaagtcagtattaaggctggggatactttaaccattaagttgccagagcaattacaatttacgactgctctaactttcgatgttatgcataccaatgggcaattagctggtaaagcaacaactgatcctaatacaggagaagtaacagttacctttactgatatttttgaaaaactgcctaatgataaggctatgacattaaattttaatgcacaattgaatcataacaatatttctattcctggtgttgtaaactttaactataataatgttgcttatagctcttatgttaaagacaaagatattacgccaataagtccagatgttaacaaagtgggttatcaggataaaagtaatcctggtttgattcactggaaagttctcattaacaacaaacaaggtgctattgataatttgactttgactgatgttgtcggagaagatcaagaaatcgtaaaagattccttggttgctgcacgcttgcagtacattgctggtgatgatgttgacagtttagatgaagctgcttcgcgaccttatgctgaggatttttcaaaaaatgttacttatcaaactaatgatttaggattgacaacaggatttacctatacaattccaggatccagtaacaacgctatctttatctcttatactactcgtttaacttcttctcaatctgctggtaaagatgtcagcaacactattgctatttcaggaaataatattaattattccaatcaaacaggctacgctcgtattgaatccgcatatggtagagctagttctagagtaaagaggcaagcagaaacaacaactgttactgaaacaacaacttcgtcatcttctgaaacgacaactagtgaagcgacaacagaaacaagtagtacaacaaataataattcaactactacagaaacagctactagcacaacaggagcttcaacaacacaaacaaaaacgactgcttctcaaacgaatgttccgacaacaacaaacataacaacaacttcaaaacaagtaaccaagcaaaaagcgaaatttgttttaccatcaacaggtgaacaagcagggcttttgttaactactgtaggtcttgtaattgttgctgtggcaggtgtctatttctatagaacacgtcgttaa

SEQ ID NO: 608 - DNA, 816 bp, Streptococcus mutans UA159
atgacatttaaaaagttagttttaggtttgttgagttttgtggctgtatttactttagtagcttgcagttcttctaattcaaaaaatttacaggatgatattaaagaaaagaaaaagttagttgttgctgttagtccggactatgctccttttgagttcaaggctcttgtgaacggtaaggatactgttgttggtgctgatattgatttggcaaaagcaattgctaaagaattgggagtgaaactggaattatcttccatgagttttgataatgtcttgtccagtttaaaaacaggaaaagcagacatagctatctctggtttatcttataccaaggaacgtgctcaagcctatgacttttcagaagcttattataaaacggaaaatgctattcttattaaaaagtctgatttgaacaaatatacaatgatttcttcttttaataataagactaaagtagctgttcaaaaaggaacgattgaagaaggattagctaaaaatcaattaaaacaatcaaacattacctctttgacttcgatgggcgaagctgttaatgagctcaaatctggtcaggttgatgctattgatcttgaaaaaccagtggcagaaggttatgtgtctcaaaatagtgatttggttcttgccaaagttgccttaaaaacgggtgaaggggatgccaaagcagttgctctgcctaaagacagtggtcaattagttaagacggtgaataaggttattaagaaactcaaaaaagaagataaatacaagcagtttatcagcgatgctgttaaattaactggtcagcaagtggattga

SEQ ID NO: 609 - DNA, 852 bp, Streptococcus mutans UA159
atgaaaaagcattttttcatgacttttagcctcttgctagcggctgtttttctagttgcttgttccaatctttccgattctggacagaggaattgggataagataaataagagaggaatgcttaaaattgctactgcaggaacgctttatccgcaatcttatcatgatgatcataataaattgacgggttatgatgttgaaattctaaaagaaataggaaaacgtttgggattgaaagttcagtttactgaaatgggtgtcgatggtatgctgacagccatcaagagcggtcagatcgatgttgctaattattccctagaagacggcaacaaaaatatcagtaagtttttgagaacctctccctataaatattcttttacgtcaatggttgtccgctctaaagatgattcaggtattcattcttggtcagaccttaagggaaaaaaagctgccggagctgccagcactaattatatgaagattgctaaaaaattaggagcaaaattagttgtctatgataatgtcaccaacgatgtttatatgaaagatttagttaatggtcgtacagatgtcattatcaatgattattatctgcaaaagatagctgttgcagcagtcaaagacaaatacgctatcaaaataaaccaaggactttatgccaatccttacagcactagttttacattgtctttgaaaaacaaagtactgcaaaagaaaatcaataaggctgtgaaagacatgcgcaaggatggcaccctaaccaagctatctaagaagtttttccaaggagaagacgtcactaaaaaacattataatagctataaaaaaattgatatttctgacgttgattaa

SEQ ID NO: 610 - DNA, 885 bp, Streptococcus pneumoniae R6
atgaagcttttgaaaaaaatgatgcaagtcgcactagccacatttttcttcggtttgctagggaccagtacagtatttgcagatgattctgaaggatggcagtttgtccaagaaaatggtagaacctactacaaaaagggggctctaaaagaaacctactggagagtgatagatgggaagtactattattttgatcctttatccggagagatggttgtcggctggcaatatatacctgctccacacaagggggttacgattggtccttctccaagaatagagattgctcttagaccagattggttttattttggtcaagatggtgtcttacaagaatttgttggcaagcaagttttagaagcaaaaactgctacgaataccaacaaacatcatggggaagaatatgatagccaagcagagaaacgagtctattattttgaagatcagcgtagttatcatactttaaaaactggttggatttatgaagagggttattggtattatttacagaaggatggtggctttgattctcgcatcaacagattgacggttggagagctagcacgtggttgggttaaggattaccctcttacgtatgatgaagagaagctaaaagcagctccatggtactatctagatccagcaactggctggcaaaaccttgggaacaaatggtactatctccgttcatcaggagctatggcaactggttggtatcaggaaggttcgacttggtactatctaaatgcaagtaatggagatatgaaaacaggctggttccaagtcaatggtaactggtactatgcctatgattcaggtgctttagctgttaataccacagtaggtggttactacttaaactataatggtgaatgggttaagtaa

SEQ ID NO: 611 - DNA, 1017 bp, Streptococcus pneumoniae R6
atgaaacttttgaaaaaaatgatgcaagttctactagcagtctttttctttggtttgctagctacaaatacggtatttgcgaataccacaggtggccgatttgttgataaggataatagaaaatattatgtaaaagatgatcataaagcaatctattggcataaaatagacggtaaaacttactattttggtgatattggagagatggttgtcggttggcaatacttagaaattcctggaacaggttatcgtgataatttattcgataaccaaccagttaatgaaattggccttcaggagaagtggtactattttggacaagatggtgctttgctagaacaaacagataaacaagtactagaggcaaaaacgtctgaaaatacaggaaaagtatacggtgaacaatatcctctatctgctgaaaagagaacttattattttgataataattatgctgtaaagacaggctggatttatgaagacggcaattggtattatttaaataagctaggaaattttggcgatgattcttacaatccactaccaattggtgaagttgctaagggttggactcaagattttcatgttactattgacattgatagaagcaaacctgctccatggtactacctagatgcttcaggtaagatgcttacagattggcaaaaagtaaacggaaaatggtattattttggctcctctggttctatggcaacaggttggaaatatgtacgaggcaaatggtattacttagataataaaaatggtgatatgaaaacaggatggcaataccttggtaacaagtggtactacctccgttcatcaggagctatggtaactggctggtatcaagatggtttaacttggtactacctaaatgcaggtaatggagacatgaagacaggttggttccaggtcaatggcaaatggtactatgcttatagctcaggtgccttggcagtgaatacgaccgtagatggctattctgtcaactataatggcgaatgggttcaataa

SEQ ID NO: 612 - DNA, 1860 bp, Streptococcus pneumoniae R6
atgaataagaaaaaaatgattttaacaagtctagccagcgtcgctatcttaggggctggttttgttgcgtctcagcctactgttgtaagagcagaagaatctcccgtagccagtcagtctaaagctgagaaagactatgatgcagcgaagaaagatgctaagaatgcgaaaaaagcagtagaagatgctcaaaaggctttagatgatgcaaaagctgctcagaaaaaatatgacgaggatcagaagaaaactgaggagaaagccgcgctagaaaaagcagcgtctgaagagatggataaggcagtggcagcagttcaacaagcgtatctagcctatcaacaagctacagacaaagccgcaaaagacgcagcagataagatgatagatgaagctaagaaacgcgaagaagaggcaaaaactaaatttaatactgttcgagcaatggtagttcctgagccagagcagttggctgagactaagaaaaaatcagaagaagctaaacaaaaagcaccagaacttactaaaaaactagaagaagctaaagcaaaattagaagaggctgagaaaaaagctactgaagccaaacaaaaagtggatgctgaagaagtcgctcctcaagctaaaatcgctgaattggaaaatcaagttcatagactagaacaagagctcaaagagattgatgagtctgaatcagaagattatgctaaagaaggtttccgtgctcctcttcaatctaaattggatgccaaaaaagctaaactatcaaaacttgaagagttaagtgataagattgatgagttagacgctgaaattgcaaaacttgaagatcaacttaaagctgctgaagaaaacaataatgtagaagactactttaaagaaggtttagagaaaactattgctgctaaaaaagctgaattagaaaaaactgaagctgaccttaagaaagcagttaatgagccagaaaaaccagctccagctccagaaactccagccccagaagcaccagctgaacaaccaaaaccagcgccggctcctcaaccagctcccgcaccaaaaccagagaagccagctgaacaaccaaaaccagaaaaaacagatgatcaacaagctgaagaagactatgctcgtagatcagaagaagaatataatcgcttgactcaacagcaaccgccaaaagctgaaaaaccagctcctgcaccaaaaacaggctggaaacaagaaaacggtatgtggtacttctacaatactgatggttcaatggcgacaggatggctccaaaacaacggttcatggtactacctcaacagcaatggtgctatggctacaggttggctccaatacaatggttcatggtattacctcaacgctaacggtgctatggcaacaggttgggctaaagtcaacggttcatggtactacctcaacgctaatggtgctatggctacaggttggctccaatacaacggttcatggtattacctcaacgctaacggcgctatggcaacaggttgggctaaagtcaacggttcatggtactacctcaacgctaatggtgctatggctacaggttggctccaatacaacggttcatggtactacctcaacgctaacggtgctatggctacaggttgggctaaagtcaacggttcatggtactacctcaacgctaatggtgctatggcaacaggttgggtgaaagatggagatacctggtactatcttgaagcatcaggtgctatgaaagcaagccaatggttcaaagtatcagataaatggtactatgtcaatggtttaggtgcccttgcagtcaacacaactgtagatggctataaagtcaatgccaatggtgaatgggtttaa

SEQ ID NO: 613 - DNA, 1347 bp, Streptococcus pneumoniae R6
atgaaaattttaccgtttatagcaagaggaacaagttattacttgaagatgtcagttaaaaagcttgttccttttttagtagtaggattgatgctagcagctggtgatagtgtctatgcctattccagaggaaatggatcgattgcgcgtggggatgattatcctgcttattataaaaatgggagccaggagattgatcagtggcgcatgtattctcgtcagtgtacttcttttgtagcctttcgtttgagtaatgtcaatggttttgaaattccggcagcttatggaaatgcgaatgaatggggacatcgtgctcgtcgggaaggttatcgtgtagataatacaccgacgattggttccattacttggtctactgcaggaacttatggtcatgttgcctgggtgtcaaatgtaatgggagatcagattgagattgaggaatataactatggttatacagaatcctataataaacgagttataaaagcaaacacgatgacaggatttattcattttaaagatttggatagtggcagtgttgggaatagtcaatcctcagcttcaacaggcggaactcattattttaagaccaagtctgctattaaaactgaacccctagttagtgcaactgtgattgattactattatcctggggagaaggttcattatgatcagatacttgaaaaagacggctataagtggttgagttatactgcctataatggaagctatcgttatgttcaattggaggctgtgaataaaaatcctctaggtaattctgttctttcttcaacaggaggaactcattattttaagatcaagtctgctattaaaactgaacccctagttagtgcaactgtgattgattactattatcctggagagaaggttcattatgatcagatacttgaaaaagacggctataagtggttgagttatacggcttataacggaagtcgtcgctatatacagctagagggagtgacttcttcacaaaattatcagaatcaatcaggaaatatctctagctatggatccaataatagttcaactgtcggttggaagaaaataaatggtagttggtatcatttcaaatcaaatggttctaaatcaacaggatggctgaaagacggttctagctggtattatttgaaattatctggtgaaatgcagacaggatggttaaaggagaatggctcgtggtattatctgggtagttcaggggcaatgaaaacaggctggtaccaggtctctggtgagtggtattattcttactcttcaggcgccttagctattaatacgacggtggatggctacagagtaaacagtgatggagaacgagtatag

SEQ ID NO: 614 - DNA, 2106 bp, Streptococcus pneumoniae R6
atgtttgcatcaaaaagcgaaagaaaagtacattattcaattcgtaaatttagtattggagtagctagtgtagctgttgccagtcttgttatgggaagtgtggttcatgcgacagagaacgagggaagtacccaagcagccacttcttctaatatggcaaagacagaacataggaaagctgctaaacaagtcgtcgatgaatatatagaaaaaatgttgagggagattcaactagatagaagaaaacatacccaaaatgtcgccttaaacataaagttgagcgcaattaaaacgaagtatttgcgtgaattaaatgttttagaagagaagtcgaaagatgagttgccgtcagaaataaaagcaaagttagacgcagcttttgagaagtttaaaaaagatacattgaaaccaggagaaaaggtagcagaagctaagaagaaggttgaagaagctaagaaaaaagccgaggatcaaaaagaagaagatcgtcgtaactacccaaccaatacttacaaaacgcttgaacttgaaattgctgagttcgatgtgaaagttaaagaagcggagcttgaactagtaaaagaggaagctaaagaatctcgaaacgagggcacaattaagcaagcaaaagagaaagttgagagtaaaaaagctgaggctacaaggttagaaaacatcaagacagatcgtaaaaaagcagaagaagaagctaaacgaaaagcagatgctaagttgaaggaagctaatgtagcgacttcagatcaaggtaaaccaaaggggcgggcaaaacgaggagttcctggagagctagcaacacctgataaaaaagaaaatgatgcgaagtcttcagattctagcgtaggtgaagaaactcttccaagctcatccctgaaatcaggaaaaaaggtagcagaagctgagaagaaggttgaagaagctgagaaaaaagccaaggatcaaaaagaagaagatcgccgtaactacccaaccaatacttacaaaacgcttgaccttgaaattgctgagtccgatgtgaaagttaaagaagcggagcttgaactagtaaaagaggaagctaaggaacctcgagacgaggaaaaaattaagcaagcaaaagcgaaagttgagagtaaaaaagctgaggctacaaggttagaaaacatcaagacagatcgtaaaaaagcagaagaagaagctaaacgaaaagcagcagaagaagataaagttaaagaaaaaccagctgaacaaccacaaccagcgccggctactcaaccagaaaaaccagctccaaaaccagagaagccagctgaacaaccaaaagcagaaaaaacagatgatcaacaagctgaagaagactatgctcgtagatcagaagaagaatataatcgcttgactcaacagcaaccgccaaaaactgaaaaaccagcacaaccatctactccaaaaacaggctggaaacaagaaaacggtatgtggtacttctacaatactgatggttcaatggcaacaggatggctccaaaacaacggttcatggtactatctaaacgctaatggtgctatggcgacaggatggctccaaaacaatggttcatggtactatctaaacgctaatggttcaatggcaacaggatggctccaaaacaatggttcatggtactacctaaacgctaatggtgctatggcgacaggatggctccaatacaatggttcatggtactacctaaacagcaatggcgctatggcgacaggatggctccaatacaatggctcatggtactacctcaacgctaatggtgatatggcgacaggatggctccaaaacaacggttcatggtactacctcaacgctaatggtgatatggcgacaggatggctccaatacaacggttcatggtattacctcaacgctaatggtgatatggcgacaggttgggtgaaagatggagatacctggtactatcttgaagcatcaggtgctatgaaagcaagccaatggttcaaagtatcagataaatggtactatgtcaatggctcaggtgcccttgcagtcaacacaactgtagatggctatggagtcaatgccaatggtgaatgggtaaactaa

SEQ ID NO: 615 - DNA, 2073 bp, Streptococcus pneumoniae R6
atgaaaaaaactacaatattatcattaactacagctgcggttattttagcagcatatgtccctaatgaaccaatcctagcagcatatgtccctaatgaaccaatcctagcagatactcctagttcggaagtaatcaaagagactaaagttggaagtattattcaacaaaataatatcaaatataaggttctaactgtagaaggtaacataggaactgttcaagtgggtaatggagttactcctgtagagtttgaagctggtcaagatggaaaaccattcacgattcctacaaaaatcacagtaggtgataaagtatttaccgttactgaagtagctagtcaagcttttagttattatccagatgaaacaggtagaattgtctactatcctagctctattactatcccatcaagcataaaaaaaatacaaaaaaaaggcttccatggaagtaaagctaaaactattatttttgacaaaggcagtcagctggagaaaattgaagatagagcttttgatttttctgaattagaagagattgaattgcctgcatctctagaatatattggaacaagtgcattttcttttagtcaaaaattgaaaaagctaaccttttcctcaagttcaaaattagaattaatatcacatgaggcttttgctaatttatcaaatttagagaaactaacattaccaaaatcggttaaaacattaggaagtaatctatttagactcactactagcttaaaacatgttgatgttgaagaaggaaatgaatcgtttgcctcagttgatggtgttttgttttcaaaagataaaactcaattaatttattatccaagtcaaaaaaatgacgaaagttataaaacgcctaaggagacaaaagaacttgcatcatattcgtttaataaaaattcttacttgaaaaaactcgaattgaatgaaggtttagaaaaaatcggtacttttgcatttgcggatgcgattaaacttgaagaaattagcttaccaaatagtttagaaactattgaacgtttagccttttacggtaatttagaattaaaagaacttatattaccagataatgttaaaaattttggtaaacacgttatgaacggtttaccaaaatttttaacattatctggtaataatatcaactcattgccgtccttcttcctaagtggcgtcttagattcattaaaggaaattcatattaagaataaaagtacagagttttctgtgaaaaaagatacatttgcaattcctgaaactgttaagttctatgtaacatcagaacatataaaagatgttcttaaatcaaatttatctactagtaatgatatcattgttgaaaaagtagataatataaaacaagaaactgatgtagctaaacctaaaaagaattctaatcagggagtagttggttgggttaaagacaaaggtttatggtattacttaaacgaatcaggttcaatggctactggttgggttaaagacaaaggtttatggtattacttaaacgaatcaggttcaatggctactggttgggttaaagacaaaggtttatggtattacttaaatgaatcaggttcaatggctactggttgggttaaagacaaaggcttatggtattacttaaacgaatcaggttcaatggctactggttgggttaaagacaaaggcttatggtattacttaaacgaatcaggttcaatggctactggttgggttaaagacaaaggcttatggtattacttaaatgaatcaggttcaatggctactggttgggttaaagacaaaggcttatggtattacttaaacgaatcaggttcaatggctactggttgggttaaagacaaaggcttatggtattacttaaacgaatcaggttcaatggctactggttgggttaaagacaaaggcttatggtattacttaaatgaatcaggttcaatggctactggttgggttaaagtttctggtaaatggtactatacctataattcaggagatttattagtaaacacgactacacccgatggctatcgagtcaatgctaacggtgagtgggtaggatag

SEQ ID NO: 616 - DNA, 957 bp, Streptococcus pneumoniae R6
atggaaattaatgtgagtaaattaagaacagatttgcctcaagtcggcgtgcaaccatataggcaagtacacgcacactcaactgggaatccgcattcaaccgtacagaatgaagcggattatcactggcggaaagacccagaattaggttttttctcgcacattgttgggaacggttgcatcatgcaggtaggacctgttgataatggtgcctgggacgttgggggcggttggaatgctgagacctatgcagcggttgaactgattgaaagccattcaaccaaagaagagttcatgacggactaccgcctttatatcgaactcttacgcaatctagcagatgaagcaggtttgccgaaaacgcttgatacagggagtttagctggaattaaaacgcacgagtattgcacgaataaccaaccaaacaaccactcagaccacgttgacccttatccatatcttgctaaatggggcattagccgtgagcagtttaagcatgatattgagaacggcttgacgattgaaacaggctggcagaagaatgacactggctactggtacgtacattcagacggctcttatccaaaagacaagtttgagaaaatcaatggcacttggtactactttgacagttcaggctatatgcttgcagaccgctggaggaagcacacagacggcaactggtactggttcgacaactcaggcgaaatggctacaggctggaagaaaatcgctgataagtggtactatttcaacgaagaaggtgccatgaagacaggctgggtcaagtacaaggacacttggtactacttagacgctaaagaaggcgccatggtatcaaatgcctttatccagtcagcggacggaacaggctggtactacctcaaaccagacggaacactggcagacaggccagaattcacagtagagccagatggcttgattacagtaaaataa

SEQ ID NO: 617 - DNA, 384 bp, Neisseria meningitidis Z2491
atgactttcgcctattggtgtattctgattgcctacctattgccgcttttttgtgcggcgtatgccaaaaaagcgggcggattccggtttaaagacaaccacaatccgcgcgattttctggcgcgcacgcaaggcacagccgcccgtgcccacgccgcgcagcaaaacggttttgaagcctttgcaccgtttgcagccgccgttttgacggcacacgcaaccggcaatgccggacaagcaaccgtcaacacgcttgccggcctgttcatcctgttccgcctcgcctttatctggtgctacatcgcagacaaagcagcattacgctcgctgatgtgggtgggcggatttgtctgcaccgtcgggctgtttgtcgtggctgcttga

SEQ ID NO: 618 - DNA, 1779 bp, Neisseria meningitidis Z2491
atgaacaaaatataccgcatcatttggaatagtgccctcaatgcctgggtcgccgtatccgagctcacacgcaaccacaccaaacgcgcctccgcaaccgtgaagaccgccgtattggcgacactgttgtttgcaacggttcaggcgaatgctaccgatgaagatgaagaagaagagttagaatccgtacaacgctctgtcgtagggagcattcaagccagtatggaaggcagcggcgaattggaaacgatatcattatcaatgactaacgacagcaaggaatttgtagacccatacatagtagttaccctcaaagccggcgacaacctgaaaatcaaacaaaacaccaatgaaaacaccaatgccagtagcttcacctactcgctgaaaaaagacctcacaggcctgatcaatgttgaaactgaaaaattatcgtttggcgcaaacggcaagaaagtcaacatcataagcgacaccaaaggcttgaatttcgcgaaagaaacggctgggacgaacggcgacaccacggttcatctgaacggtatcggttcgactttgaccgatacgcttgcgggttcttctgcttctcacgttgatgcgggtaaccaaagtacacattacactcgtgcagcaagtattaaggatgtgttgaatgcgggttggaatattaagggtgttaaaactggctcaacaactggtcaatcagaaaatgtcgatttcgtccgcacttacgacacagtcgagttcttgagcgcagatacgaaaacaacgactgttaatgtggaaagcaaagacaacggcaagagaaccgaagttaaaatcggtgcgaagacttctgttattaaagaaaaagacggtaagttggttactggtaaaggcaaaggcgagaatggttcttctacagacgaaggcgaaggcttagtgactgcaaaagaagtgattgatgcagtaaacaaggctggttggagaatgaaaacaacaaccgctaatggtcaaacaggtcaagctgacaagtttgaaaccgttacatcaggcacaaatgtaacctttgctagtggtaaaggtacaactgcgactgtaagtaaagatgatcaaggcaacatcactgttatgtatgatgtaaatgtcggcgatgccctaaacgtcaatcagctgcaaaacagcggttggaatttggattccaaagcggttgcaggttcttcgggcaaagtcatcagcggcaatgtttcgccgagcaagggaaagatggatgaaaccgtcaacattaatgccggcaacaacatcgagattagccgcaacggtaaaaatatcgacatcgccacttcgatggcgccgcagttttccagcgtttcgctcggcgcgggggcagatgcgcccactttaagcgtggatgacgagggcgcgttgaatgtcggcagcaaggatgccaacaaacccgtccgcattaccaatgtcgccccgggcgttaaagagggggatgttacaaacgtcgcacaacttaaaggcgtggcgcaaaacttgaacaaccgcatcgacaatgtggacggcaacgcgcgtgcgggcatcgcccaagcgattgcaaccgcaggtctggttcaggcgtatctgcccggcaagagtatgatggcgatcggcggcggcacttatcgcggcgaagccggttacgccatcggctactccagtatttccgacggcggaaattggattatcaaaggcacggcttccggcaattcgcgcggccatttcggtgcttccgcatctgtcggttatcagtggtaa

SEQ ID NO: 619 - DNA, 426 bp, Neisseria meningitidis Z2491
attcttttggctgaaggtcaaaaatcagccgtcaccgagtattacctgaatcacggcacatggcccagcaacaacagtgatgccggcgtggcatccaccgccaccgacatcaaaggaaaatatgttaaagaagttaaagtcgaaaaaggcgtcattaccgccacaatgctttcaagcggcgtaaacaacgaaatcaaaggcaaaaaactctccctgtgggccaagcgtcaagccggttcggtaaaatggttctgcggacagccggttgagcgcgccgccaacaacgccgccaacgacgccgtcaccgccgccaccgccaacggcaacggcaagatcgacaccaaacacctgccgtcaacctgccgcgacgcagcatctgccgtttgcatagaaacaccacctacggctttctataaaaatacctaa

SEQ ID NO: 620 - DNA, 4350 bp, Neisseria meningitidis Z2491
atgaaaacaaccgacaaacggacaaccgaaacacaccgcaaagccccgaaaaccggccgcatccgcttctcgcctgcttacttagccatatgcctgtcgttcggcattcttccccaagcttgggcgggacacacttatttcggcatcaactaccaatactatcgcgactttgccgaaaataaaggcaagtttgcagtcggggcgaaagatattgaggtttacaacaaaaaaggggagttggtcggcaaatcaatgacaaaagccccgatgattgatttttctgtggtgtcgcgtaacggcgtggcggcattggtgggcgatcaatatattgtgagcgtggcacataacggcggctataacaacgttgattttggtgcggaaggaagaaatcccgatcagcaccgtttttcttaccaaattgtgaaaagaaataattataagcctgacaattcacacccttacaacggcgattaccatatgccgcgtttgcataaatttgtcacagatgcagaacctgtcgaaatgacgagtgacatgagggggaatacctattccgataaagaaaaatatcccgagcgtgtccgcatcggctcaggacaccactattggcgttatgatgatgacaaacacggcgatttatcctactccggcgcatggttaattggcggcaatacacatatgcagggttggggaaataatggcgtagttagtttgagcggcgatgtgcgccatgccaacgactatggccctatgccgattgcaggtgcggcaggcgacagcggttcgccaatgtttatttatgacaaaacaaacaataaatggctgctcaacggagttttacaaaccggctacccttattccggcagggaaaacggtttccagctgatacgcaaagattggttctacgatgacatttacagaggcgatacacataccgtcttttttgaaccgcgcagtaacggacatttttcctttacatccaacaacaacggtacgggtacggtaacagaaaccaacgaaaaggtttccaatccaaagcttaaagtacagacagtccgactgtttgacgaatctttgaatgaaactgataaagaaccagtttacgcggcagggggtgttaatcagtaccgtccaaggttaaacaacggtgaaaacctttcttttatcgattacggcaacggcaaactcatcttatcaaacaacatcaaccaaggcgcgggcggtttgtattttgaaggtgattttacggtctcgcctgaaaacaacgaaacgtggcaaggcgcgggcgttcatatcagtgaagacagtaccgttacttggaaagtaaacggcgtggcaaacgaccgcctgtccaaaatcggcaaaggcacgctgcacgttcaagccaaaggggaaaaccaaggctcgatcagcgtgggcgacggtacagtcattttggatcagcaggcagacgataaaggcaaaaaacaagcctttagtgaaatcggcttggtcagcggcaggggtacggtgcaactgaatgccgataatcagttcaaccccgacaaactctatttcggctttcgcggcggacgtttggatttaaacgggcattcgctttcgttccaccgtattcaaaataccgatgaaggggcgatgattgtcaatcataatgccacaacaacatccaccgttaccattacagggaatgaaagtattacacaaccgagtggtaagaatatcaatagacttaattacagcaaagaaattgcctacaacggttggtttggcgagaaagatacgaccaaaacgaacgggcggctcaaccttgtttaccagcccgccgcagaagaccgcaccctgctgctttccggcggaacaaatttaaacggcaacatcacgcaaacaaacggcaaactgtttttcagcggcagaccgacaccgcacgcctacaatcatttaggaagcgggtggtcaaaaatggaaggtatcccacaaggagaaatcgtgtgggacaacgactggatcaaccgcacgtttaaagcggaaaatttccatattcagggcgggcaggcggtgatttcccgcaatgttgccaaagtggaaggcgattggcatttgagcaatcacgcccaagcagtttttggtgtcgcaccgcatcaaagccatacaatctgtacacgttcggactggacgggtctgacaaattgtgtcgaaaaaaccattaccgacgataaagtgattgcttcattgactaagaccgacatcagcggcaatgtcagccttgccgatcacgctcatttaaatctcacagggcttgccacactcaacggcaatcttagtgcaaatggcgatacacgttatacagtcagccacaacgccacccaaaacggcaaccttagcctcgtgggcaatgcccaagcaacatttaatcaagccacattaaacggcaacacatcggcttcgggcaatgcttcatttaatctaagcaacaacgccgcacaaaacggcagtctgacgctttccgacaacgctaaggcaaacgtaagccattccgcactcaacggcaatgtctccctagccgataaggcagtattccattttgaaaacagccgctttaccggacaactcagcggcagcaaggatacagcattacacttaaaagacagcgaatggacgctgccgtcaggcacggaattaggcaatttaaaccttgacaacgccaccattacactcaattccgcctatcgccacgatgctgcaggcgcgcaaaccggcagtgtgtcagacacgccgcgccgccgttcgcgccgttccctattatccgttacaccgccaacttcggtagaatcccgtttcaacacgctgacggtaaacggcaaattgaacggtcaaggaacattccgctttatgtcggaactcttcggctaccgaagcgacaaattgaagctggcggaaagttccgaaggcacttacaccttggcggtcaacaataccggcaacgaacccgtaagcctcgatcaattgacggtagtggaagggaaagacaacaaaccgctgtccgaaaaccttaatttcaccctgcaaaacgaacacgtcgatgccggcgcgtggcgttaccaactcatccgcaaagacggcgagttccgcctgcataatccggtcaaagaacaagagctttccgacaaactcggcaaggcagaagccaaaaaacaggcggaaaaagacaacgcgcaaagccttgacgcgctgattgcggccgggcgcgatgccgccgaaaagacagaaagcgttgccgaaccggcccggcaggcaggcggggaaaatgtcggcattatgcaggcggaggaagagaaaaaacgggtgcaggcggataaagacagcgccttggcgaaacagcgcgaagcggaaacccggccggctaccaccgccttcccccgcgcccgccgcgcccgccgggatttgccgcaaccgcagccccaaccgcaacctcaaccccaaccgcagcgcgacctgatcagccgttatgccaatagcggtttgagtgaattttccgccacgctcaacagcgttttcgccgtacaggacgaattggaccgcgtgtttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacaccttcgacgacggcatcggcaactcggcacggcttgcccacggcgccgttttcgggcaatacggcatcggcaggttcgacatcggcatcagcacgggcgcgggttttagcagcggcagtctttcagacggcatcggaggcaaaatccgccgccgcgtgctgcattacggcattcaggcacgataccgcgccggtttcggcggattcggcatcgaaccgtacatcggcgcaacgcgctatttcgtccaaaaagcggattaccgctacgaaaacgtcaatatcgccacccccggtcttgcgttcaaccgctaccgcgcgggcattaaggcagattattcattcaaaccggcgcaacacatttccatcacgccttatttgagcctgtcctataccgatgccgcttcgggcaaagtccgaacacgcgtcaataccgccgtattggctcaggatttcggcaaaacccgcagtgcggaatggggcgtaaacgccgaaatcaaaggtttcacgctgtccctccacgctgccgccgccaaaggcccgcaactggaagcgcaacacagcgcgggcatcaaattaggctaccgctggtaa

SEQ ID NO: 621 - DNA, 513 bp, Neisseria meningitidis Z2491
atgaacacccttcaaaaaggttttacccttatcgagctgatgattgtgattgccatcgtcggcattttggcggcagtcgcccttcctgcttatcaagactacacagcccgcgcacaagtttccgaagccattcttttagccgaaggtcaaaaatcagccgtcaccgagtattacctgaatcacggcgaatggcccagcaacaacacttctgccggcgtggcatcctccaccgacattaaaggcaaatatgttcaaagcgttgaagtcaaaaacggcgtcgttaccgccacaatggcttcaagcaacgtaaacaacgaaatcaaaggcaaaaaactctccctgtgggccaagcgtcaagacggttcggtaaaatggttctgcggacagccggttaagcgcaacgacaccgccaccaccaacgacgacgtcaaagccgacaccgccgccaacggcaagcagatcgacaccaagcacctgccgtcaacctgccgcgacgcagcatctgccggataa

SEQ ID NO: 622 - DNA, 963 bp, Neisseria meningitidis Z2491
atgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctcgcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacggatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatgggaccgtataaagtaagcaaaggaattaaaccgacagaaggattaatggtcgatttctccgatatccaaccatacggcaatcatatgggtaactctgccccatccgtagaggctgataacagtcatgaggggtatggatacagcgatgaagcagtgcgacgacatagacaagggcaaccttga

SEQ ID NO: 623 - DNA, 423 bp, Neisseria meningitidis Z2491
atgcgcccaatcttcctatctttcgttttattccctattttgataaccgcctgcagcacaccggacaagtctgcccgatgggaaaatatcggcacaatctcaaacggcaatattcatacatatatcaataaagacagcgtgagaaaaaacggaaatctgatgattttccaagataaaaaagttgttaccaatctaaaacaagaacgttttgccaacacccccgcatacaagactgccattgccgagtgggaaatccactgcaacaacaaaacataccgcttaagttcgctacaattgtttgatacaaaaaacacggaaatttccacacaaaactacacagcctcttccctccgcccgatgagcatcctgtccgggacattaaccgaaaaacaatatgaaaccgtatgcggaaaaaaactctga

SEQ ID NO: 624 - DNA, 255 bp, Neisseria meningitidis Z2491
atgaacaaacttttcattaccgccctgtccgccctcgccttgtccgcctgcgccggcacttgggagggcgcgaaacaagacaccgcccgcaaccttgacaaaacacaggccgccgccgaacgcgccgccgaacaaacaggcaacgccgtcgaaaaaggctgggacaaaaccaaagaagccgtcaaaaaaggcggcaatgccgtcggacgcggcatttcccatctcggcggaaaaatcgaaaacgccaccgaataa

SEQ ID NO: 625 - DNA, 372 bp, Neisseria meningitidis Z2491
atgaaactcctcttcatccccctagtcctcttcgtcgccgtcgaacatttctacatcgcctggcttgaaatgacgcagattcccagcgaaaaagcggcggaaacgttcaagctgccttatgaatttatggaacaaaatcgcgtgcagaccctgttcggcaaccaagggctgtataacggctttctcggcatcgggctggtgtggtcgcggtttgccgctccggataacgcggtgtacggcgcaacggtactgtttctcggcttcgtcctgattgccgccgcgtggggcgcgttctcttccggcaacaaaggcatactcgtcaaacaaggtttgcccgcatttttggcagcggcggcggtgttggcggtatga

SEQ ID NO: 626 - DNA, 363 bp, Neisseria meningitidis Z2491
atggcttcaagcaacgtaaacaacgaaatcaaagacaaaaaactctccctgtgggccaagcgtcaagacggttcggtaaaatggttctgcggacagccggttaagcgcgacgccgccaccgacgccgacgtcaccgccgacagcggcaacgaaatcgacaccaagcacctgccgtcaacctgccgcgacgcagcatctgccgtttgcacaaaaacacccgagtattacccgaatcacggcgaatggccgaaaaacttcgtcattcccgcgcaggcgggaatccaggtctgtcggcacggaaacttatcgggtaaaaaggtttctccggtcctgagttctagattcccactttcgtgggaatga

SEQ ID NO: 627 - DNA, 387 bp, Neisseria meningitidis Z2491
atccttttagccgaaggtcaaaaatcagccgtcaccgagtattacctgaatcacggcgaatggcccagcaacaacacttctgccggcgtggcaacctccaccgacattaaaggcaaatatgttcaaagcgttgaagtcaaaaacggcgtcgttaccgccacaatggcttcaagcaacgtaaacaacgaaatcaaaggcaaaaaactctccctgtgggccaagcgtcaagacggttcggtaaaatggttctgcggacagccggttaagcgcaacgacaccgccaccaccaacgacgacgtcaaagccgacaccgccgccaacggcaagcagatcgacaccaagcacctgccgtcaacagcatcgacaagaaaatcgacaccaaactag

SEQ ID NO: 628 - DNA, 2433 bp, Neisseria meningitidis Z2491
atgcccatcccctttaaacccgtattggctgccgccgccatcgcccaagcgtttcccgcctttgcggcagaccccgcgccgcagtccgcccaaacgctgaacgaaatcaccgttaccggcacgcacaaaacccaaaaactcggcgaagaaaaaatccgccgcaaaactttagacaagctcttggtcaacgacgaacacgacctggtgcgctacgaccccggcatttccgtcgtcgaaggcggcagggcgggttctaacggctttaccatacgcggcgtggacaaagaccgcgtcgccatcaacgttgacgggctggcgcaggcggaaagccgctcttccgaagccttccaagaattgttcggcgcgtacggcaacttcaacgccaaccgcaacacttccgagccggaaaacttttccgaagtaaccatcaccaaaggcgcggactcgctcaaatccggcagcggcgcattgggcggcgcagtcaattaccaaaccaaatccgcaagcgattatgtttccgaagacaagccctaccatttggggataaagggcggcagcgtcggcaaaaacagccaaaaattcagcagcatcaccgccgccggcaggctctttggtttggatgccttattggtttatacccgccgcttcggcaaagaaaccaaaaaccgctcgaccgagggcgatatcgaaattaaaaacgacggatatgtctataacccgaccgatacaggcggacccagcaagtacctgacctatgtagccacaggggttgcgcgctcccaacccgacccgcaagaatgggtaaacaaaagcaccctgttcaagctgggctacaacttcaacgatcaaaaccgtatcggctggatttttgaagactcgcgcaccgaccgttttaccaacgagctgtctaatttgtggacgggtacgaccacgtctgccgcaacgggcgactaccgccaccgccaagacgtgagctaccgccgccgctccggtgtcgaatacaaaaacgaattggaacacggcccgtgggacagccttaagctgcgctacgacaagcagcgcatcgatatgaacacttggacttgggacatcccgaaaaattacgataaaagaggcatcaacggcgaggtttaccattcgttccggcatatccgccaaaacaccgcgcaatggactgccgattttgaaaaacaactcgacttttccaaagccgtttgggcggcgcaatacggcttgggcggcggcaaaggggacaatgccaactcggattacagctatttcgcaaaactgtacgaccccaaaatcctcgcttccaaccaagccaaaatcacaatgctgatcgaaaaccggtcgaaatataaatttgcctattggaacaatgcgtttcacttgggcggcaacgaccgcttccgcctgaatgcgggcatacgctacgacaaaaacagcagcagcgcgaaagacgatccgaaatacaccaccgccatccgggggcagattccccatttgggttcggaacgcgcgcacgcgggcttcagctacggcacggggttcgactggcggtttaccaagcatctgcacttgttggcaaaatacagcaccggcttccgcgcaccgacttcggacgaaacttggctactgttcccacaccccgatttctacctgaaagccaacccaaacctgaaagccgaaaaagccaaaaactgggaattgggtctggcgggcagcggcaaagcgggcaacttcaagctctcgggcttcaaaaccaaataccgcgactttatcgaattgacgtatatgggcgtttcgtcagacgataaaaacaaccccagatacgccccgctttcagacggtacggcattggtcagctcgcccgtttggcaaaaccaaaaccgctccgccgcctgggtgaaaggcatagagtttaacggcacgtggaacctcgacagtatcggtttgcccaaagggctgcacaccggcctcaacgtcagctacatcaagggcaaggcaacgcaaaacaacggcaaagaaacgcccatcaacgcgctttcgccgtggacggcggtttacagcctgggctatgacgcgccttccaaacgctggggcatcaacgcctacgccacgcgcaccgccgccaaaaagccgtccgacaccgtccacagcaacgacgacttgaacaacccgtggccttatgccaaacacagcaaggcctatacgctgttcgacctttccgcctacctcaacatcggcaaacaggttacgctccgcgccgccgcgtacaacattaccaacaagcagtactacacttgggaatctttacgcagcatccgcgagttcggcacggtcaaccgcgttgacaacaaaacccacgccggcatccaacgctttacctcgccgggcaggagctacaatttcaccatcgaagcgaagttctaa

SEQ ID NO: 629 - DNA, 990 bp, Neisseria meningitidis Z2491
atgaaaaaatccctgattgccctgactttggcagcccttcctgttgcagcaatggctgacgttaccctgtacggcaccatcaaaaccggcgtagaaacttcccgctctgtagaacacaatggaggtcaggtggttagcgttgaaaccggtaccggcatcgttgatttgggttcgaaaatcggcttcaaaggccaagaagacctcggtaacggcctgaaagccatttggcaggttgagcaaaaggcatctatcgccggcactgactccggttggggcaaccgccaatccttcatcggcttgaaaggcggcttcggtaaattgcgcgtcggccgtttgaacagcgtcctgaaagacaccggcgacatcaatccttgggatagcaaaagcgactatttgggtgtaaacaaaattgccgaacccgaagcacgcctcatttccgtacgctacgattctcccgaatttgccggcctcagcggcagcgtacaatacgcgcttaacgacaatgtaggcagacataacagcgaatcttaccacgccggcttcaactacaaaaacggcggcttcttcgtgcaatatggcggtgcctataaaagacatcaggatgtggatgacgtgaagattgagaaataccagattcaccgtttggtcagcggttacgacaatgatgccctatacgcttccgtagccgtacagcaacaagacgcgaaactggttgaagacaattcgcacaactctcaaaccgaagttgccgctaccttggcataccgcttcggcaacgtaacgccccgcgtttcttacgcccacggcttcaaaggctcggttgatgatgcaaaacgcgacaatacttacgaccaagtggttgtcggtgcggaatacgacttctccaaacgcacttctgccttggtttctgccggttggttgcaagaaggcaaaggcgaaaacaaattcgtagcgactgccggcggtgtcggtctgcgccacaaattctaa

SEQ ID NO: 630 - DNA, 942 bp, Neisseria meningitidis Z2491
atgaaaaccctgctcctcctcatccccctcgtcctcacagcctgcggcacactgaccggcatacccgcccacggcggcggcaaacgctttgccgtcgaacaagaactcgtcgccgcatcgtcccgcgccgccgtcaaagaaatggacttgtccgccctgaaaggacgcaaagccgccctttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgccctgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgcaccgaactgcacctctacaacgccgaaacccttaaagcccaaaccaagctcgaatatttcgccgttgaccgcgacagccggaaactgctgattgcccctaaaaccgccgcctacgaatcccaataccaagaacaatacgccctctggatgggaccttacagcgtcggcaaaaccgtcaaagcctcagaccgcctgatggtcgatttctccgacatcaccccctacggcgacacaaccgcccaaaaccgtcccgacttcaaacaaaacaacggtaaaaaacccgatgtcggcaacgaagtcatccgccgccgcaaaggaggataa

SEQ ID NO: 631 - DNA, 372 bp, Neisseria meningitidis Z2491
atgaataaaaccttgtctattttgccggtggcaatcttactcggcggctgcgccgccgggggcggtaacacattcggcagcttagacggcggcacaggtatgggcggcagcatcgtcaaaatggcggtagaaagccaatgccgtgcggaattgaacaaacgcagcgaatggcgtttgaccgcgctggcgatgagtgccgaaaaacaggcggaatgggaaaacaagatttgcgcttgcgtcgcccaagaagcacccaaccagctgaccggcaacgatgtgatgcagatgctggatccgtccacgcgcaatcaggcacttgccgccctgaccgccaaaacggtttccgcctgcttcaaacacctgtaccgctaa

SEQ ID NO: 632 - DNA, 561 bp, Neisseria meningitidis Z2491
atgaatccacttattcatcaagcaaaggaatcatctatgcaaacccgcatcctctccgccgtactgctggctttttcaaccgctgcctttgccgggggcgcattcacgctgcaattcgacaacccgtccgaagacggcggcttcacgcaaaaccagattttgagcgcgccttacggctttggctgttcgggcggcaatgcttcgcccgcgctgtcgtggaaaaatccgcccgccgggacaaaaagtttcgtcctgaccgtttacgataaagacgcgccgaccggactgggctggatgcactgggtggtcgccgacattcccgccgatgtccgccgccgcaatgcgacctcgctgcaattaagccgctgcgccagcatcgccgacgaccagtccgcagccatatcggcagtaatcagtttgcagatttgccgcatcaggttgacgccttcgtacacggcaaaaccgatgccgtcatgctgcaaccacgccaacacgccgcaaagcgcggcctccgccgcattgtgcggcacttcttcatccgtcagcaccgccgccgcataa

SEQ ID NO: 633 - DNA, 3114 bp, Neisseria meningitidis Z2491
atgaataaaactttaaaaaggcgggttttccgccataccgcgctttatgccgccatcttgatgttttcccataccggcgggggggggggggcgatggcgcaaacccgtcaatacgctattatcatgaacgagagaaaccagcccgaggtacagtggaatgggtcatattcaataaaggacaaagacaggaagcgcgaatatactcatcataatcaccaacaaggaggaagctctgtctcattcaacaatagcgatgagcttgtttctcgacaaagcggtactgccgtttttggcacagccacctacctgccgccctacggcaaggtttccggttttgatgccgccgctctgaaagagcgcaacaatgccgtcgattggattcataccacccacccagggttgataggctacagctacgacggtgtcgtatgcagaagcgccacagactgtcccaaacttgtctataaaacccgattttccttcgataatcccgacttggcaaaaacaggaggcgggttggataagcacacagagccaagccgcgacaattcgcccatttacaaattgaaggatcatccatggttgggcgtgtctttcaatttgggtgccgagggtatcgccaaaaatggtaagacaatcaacaaattggtatcttcttttaatgaaaagaatagtaataacaacctcgtctataccacggaaggccgcgatatttccttgggcaactggcagcgcgaaacgaccgccatggcctattatctgaacgccaagctgcacctgctggataaaaaacagattcaaaatatcaccgacaaaacagtgcagttgggtgtcttgaagccgagcatcgatgtgcggacaagaaatacggggactgccggcattctatcttattgggctaagtgggacattaaagataccgggcagattccagtcaagctcagcttgacgcaagtcaaagcaggccgctgcgtcaacaaagataaccccaataagaataccaaaacctcttcccccgcactgactgcccccgcgctgtggttcggagctgggcaagatggtaaggcggagatgtattccgcttcggtttccacctaccccgacagttcgagcagccgcatcttccttcaaaatctgaaaagaaaaaccgacaccagcagacccggccgctattccctcgcaaccttgaataagtcggatattgaaagtcgagagccgagtttcacaagtcggcaaaccgtcatccgattggatggcggcgtacagcagatcaaactggatagaaacaatactgaggtcactggttttaatggaaatgacggcaaaaacgacactttcggcattgttagtgaagggagcttcatgcctgatgccagcgagtggaaaaaagtattgctgccttggacggttcgtgctttcaattatgacggtcgatttaacacagtcaacaaagaagaaaacaacggcaagccaaaatacagtcaaaaataccgcagccgcaacaacggcaagcacgagcgcaatttgggcgacatcgtcaacagccccatcgtggcggtcggcgagtatttggctacttccgccaacgacgggatggtgcatatcttcaaacaaagcggcggggacaagcgcagctacaatctgaagctcagctacatccccggcacgatgccgcgcaaggatattgaaagcaaagactccacccttgccaaagagctgcgcgcctttgccgaaaaaggctatgtgggcgaccgctacggcgtggacggcggctttgtcttgcgccgcattacagatgaccaagacaagcaaaaacacttctttatgttcggcgcaatgggccttggcggcagaggcgcatacgccttggatttgaccaaagccgacgacaatgacccgacaaaagcctctttgtttgatgtaaaagataacggcaataatggcaataacggcaataatcgcgtggaattaggctacaccgtcggcacgccgcaaatcggcaaaacccacaacggcaaatacgccgccttcctcgcctccggttatgcgactaaacagattgacagcggcgagaataaaaccgcgctgtatgtgtatgatttggaaagcaacaacggtacgctgattagaaaaatcgaagtaaccgacggcaagggcgggctttcgtcccccacgctggtggataaagatttggacggcacggtcgatatcgcctatgccggcgatcgcggcggcaagatgtaccgctttgatttaagcggcaacaacccgaacagttggactgtacgcactattttccaaggcacgaagccgattacttccgcgcccgccatttcccaactgaaagacaaacgcgtggttatcttcggtacgggcagtgatttgagtgaggatgatgtactcagtacggatgaacaacatatttacggtatttttgacaatgacacaaacacgggtacggcgcaagaggggctgggcaaagggctgctcgagcaaaagcttagtgaggaaaataaaaccttattcctgaccgattataagcgatccgacggctcgggcgacaagggctgggtagtgaaattgaaggacggacagcgcgttaccgtcaaaccgaccgtggtattgcgtaccgcctttgtaaccatccataaatatacgggtaatgacaaatgcggcgcggaaaccgccattttgggcatcaataccgccgacggcggcaagctgaccaagaaaagcgcgcgcccgattgtgccggcagccaattcgaaggtcgcgcaatattccggcgataagaaaacttccagcggcaaatccatccctataggttgtatggaaaaagacgggggaaccgtctgcccgaacggatatgtttacgacaaaccggttaatgtgcgctacctggacgaaaagaaaacagacggattttcaacaacggcagacggcgatgcgggcggcagcggaacattcaaagagggtaaaaaacccgcccgcaataaccggtgcttctccggaaaaggggtgcgcaccctgctgatgaacgatttggacagcttggatattaccggcccgatgtgcggtatgaaacgaatcagctggcgtgaagtcttctactga

SEQ ID NO: 634 - DNA, 927 bp, Neisseria meningitidis Z2491
atgaaacaccccaaactcacccttatcgccgcattgctgaccactgccgcaactgccgcccccctgccggttgtaaccagcttcagcattttaggcgacgtagccaaacaaatcggcggagagcgcgtatccatacaaagtttggtcggagccaaccaagatacgcacgcctatcatatgaccagcggcgacattaaaaaaatccgcagtgcaaaactcgtcctgattaacggcttaggacttgaagctgccgacatccaacgtgccgtcaaacagagcaaagtatcctatgccgaagcgaccaaaggcatccaacccctcaaagccgaagaagaaggcggacaccatcacgaccacgatcatgaccacgaccatgaccacgaaggacaccaccacgaccacggcgaatatgacccccacgtctggaacgaccccgtccttatgtccgcctatgcccaaaacgtcgccgaagccctgataaaggccgaccccgaaggcaaagtttattatcaacaacgcttgggcaactaccaaatgcagctcaaaaaactgcacagtgacgcacaagccgcatttaatgccgtccctgccgccaaacgcaaagtcctgaccgggcacgatgccttttcctatatgggcaaacgttaccatatcgaattcatcgccccacaaggtgtgagcagcgaagccgagccttcagccaaacaagtcgccgccatcatccgacaaatcaaacgcgaaggcatcaaagccgtatttaccgaaaatatcaaagacacccgcatggttgaccgcatcgccaaagaaaccggtgtcaacgtcagcggcaaactgtattccgacgcactcggcaacgcacccgcagacacctacatcggcatgtaccgccacaacatcaaagccttaaccaacgcgatgaagcaataa

SEQ ID NO: 635 - DNA, 1197 bp, Streptococcus pyogenes MGAS8232
atgaaaaaaagaattttatcagcagttcttgtaagtggtgttaccctcggagcagctacaactgtaggagcggaggatttgagtactaagattgctaagcaggattctattatctcaaatctgactacagagcaaaaagctgcacagaatcaagtttcagcgttacaggctcaagtaagttcactacaatctgaacaagataaactgaccgcaagaaatacagaacttgaggcactttcaaagcgatttgagcaagaaattaaggctctaacaagtcaaattgttgctcgtaatgaaaaattaaaaaatcaagctcgtagtgcttataaaaacaatgaaacttctggttacattaatgcacttttgaattctaaatcaatttctgatgttgtaaaccgtttagtagcaattaatagagctgtctctgctaacgctaaattgttagaacaacaaaaagctgataaagtttcccttgaagaaaagcaagctgctaaccaaacagctattaataccattgccgctaatatggcaatggctgaagaaaaccaaaatacattacgtactcaacaagctaatttggaagctgcaactgcaaatttagctctccaattagcatctgctactgaagataaagctaatttggtagctcaaaaagaagctgcagaaaaagctgctgctgaagccttagcacaagaacaggctgctaaagttaaggcacaagaacaggctgcacaacaagcagcatctgttgaagcagcaaaatctgctattactccagcaccacaagctactccggcagcgcaaagtagtaatgctattgaaccagctgcactcacggctccggcagctccttctgcaagaccacaaacatcatatgattcttctaatacttatccagttggacaatgcacatggggagctaaatctttagctccttgggcaggaaataattggggaaatggtggtcaatgggcttatagtgctcaagcagctggttatcgtactggttcaacgccgatggtaggtgcgattgccgtttggaacgatggtggttatggacatgtcgccgttgtagttgaggttcaaagtgcctcaagtattcgtgtgatggagtctaactacagtggtagacagtacattgctgatcaccgtggttggtttaatccaacaggtgttacatttatttatccacactaa

SEQ ID NO: 636 - DNA, 2166 bp, Streptococcus pyogenes MGAS8232
gtgattacaattaaaaatccaaaaatccttaagtggctaaagtatgtattaagtgcaattcttagccttattatccttgttattattattggtggtcttttgtttaccttctacattagcagtgctccgaaactgtcagaagcccagttaaaatcaacaaactctagcttggtttatgacggtaataacaatctgattgctgatttgggttctgaaaagcgtgaaaatgtaacagctgatagtatccctattaatctagttaatgctattacctcaattgaagataaacgtttctttaaccatcgtggagtagatctttatcgtatttttggtgctgcctttcataatctaacgagtcagaccactcaaggggggtcaacgcttgatcagcaactcattaaactagcctatttttctactaatgaatctgatcaaaccttaaaacgtaaggctcaagaagtttggcttgctcttcaaatggagcgaaaatatactaaacaagaaatcctgactttttacatcaacaaagtatatatgggtaatggcaactatggtatgctgacagccgctaagtcttattatggcaaggatcttaaggatttatcttatgcccagctagccctattggctggaatccctcaagctcctagtcaatatgatccttaccttcatcctgaagctgctcaaaatcgccgtaacgtcgtgttgcaacagatgtacatggaaaaacatctgacgaaagcagaatatgaaactgccatcgcaactcccgtcgctgaaggtctacaatcactccaacagcgctcaacttatccaaaatatatggataattatctaaaacaagttattgaagaagtcaaaaaggaaacgaataaagatatttttaccgctggtttaaaagtttataccaatattatccccgatgcgcagcagactctttataatatttatcattctggtgattatgtttactatccagaccaagatttccaagttgcttcaacgattgttgatgtgacaaatggtcatgttattgctcagcttggcggacgtaatcaggatgaaaatgtttcatttgggactaaccaagctgttttaactgatcgtgactggggttctaccatgaagccaatcacagcctatgctcctgctattgaatctggtgtttatacttctactgctcagtcgactaatgactcagtctattattggcctggaaccactacccaattgtttaactgggaccttagatataacggatggatgacaatccaagctgctattatgctatcgcgaaatgtcccagcagtccgagcactggaagccgcaggacttgactatgctcgatctttcttaagcagtttaggtattaactatcccgaaatgcactactcaaacgctatctcaagtaataacagtagctcagataaaaaatatggtgcaagtagtgaaaaaatggccgctgcatacgctgcttttgcaaatggtggtatttatcataaaccaaggtatgtcaataaagtggaatttagtgatggtacaagtaaaacatttgatgaaaaaggaaaacgtgccatgaaagaaaccacggcctatatgatgacagatatgttgaaaactgttctcacttatggtacaggtactgctgctgccattcctggtgttgcgcaagctggtaaaacagggacttctaactacactgatgaggaactagctaaaattggtgaaaaatacggcctttatccagattatgttggtacattagcgccagacgaaaactttgttggctttactaagcgctacgccatggctgtttggacaggttacaaaaaccgcttgaccccagtatacggatcaagtctagagattgcatctgacgtttatcgtagcatgatgacttacttaacaaatggttacagtgaagactggaccatgccaaatggtctttatcgcagtggtggattcctctacttaagcggaacctatgcgagcaacaccgactatactaattcggtttacaacaatctttacagcaataacacaacaacagcttctagccaaacgacttcagatgatactagtagtagcaatgatacaagtaattcaaccaatacagacaacaatggcagccatccatctaccgatgataaaaagacaactcattaa

SEQ ID NO: 637 - DNA, 1182 bp, Streptococcus pyogenes MGAS8232
atgattattactaaaaagagcttatttgtgacaagtgtcgctttgtcgttagcacctttggtgacagcgcaggcacaagagtggacaccacgatcggttacagaaatcaagtctgaactcgtcctagttgataatgtttttacttatactgtaaaatacggtgacactttaagcacaattgctgaagcaatgggaattgatgtgcatgtcttaggagatattaatcatattgctaatattgacttaatttttccagacacgatcctaacagcaaactacaaccaacacggtcaggcaacgactttgacggttcaagcacctgcttctagtccagctagcgttagtcatgtacctagcagtgagccattaccccaagcatctgccacctctcaatcgactgttcctatggcaccatctgcgacaccatctgatgttccaacgacaccattagcatctgcaaagccagatagttttgtgacagcgtcatctgagctcacatcgtcaacgaatgatgtttcgactgagttgtctagcgaatcacaaaagcagccagaagtatcacaagaagcagttccaactcctaaagcagctgaaacgactgaagtcgaacctaagacagacatctcagaagatccaacttcagctaataggcctgttcctaacgagagtgcttcagaagaagcttcttctgcggccccagcacaagctccagcagaaaaagaagaaacctctcagatgttaactgcgccagcggcacaaaaagctgtagctgacaccacaagtgttgcaacctcaaacggcctttcttacgctccaaaccatgcctacaatccaatgaatgcagggcttcaaccacaaacagcagcgttcaaagaagaagtggcttctgcctttggtattacgtcgtttagtggttaccgtccaggagatccaggagatcatggtaaaggattagccattgactttatggtaccggttagctctacgcttggtgatcaagttgctcaatatgccattgaccatatggcagagcgtggtatttcatacgttatttggaaacagcgattctatgcgccatttgcaagtatttacggaccagcctatacatggaaccccatgccagatcgcggcagtattacagaaaaccattatgatcatgttcatgtctcctttaatgcttaa

SEQ ID NO: 638 - DNA, 1548 bp, Streptococcus pyogenes MGAS8232
atgaaaaagaaaattcttttaatgatgagtttaatcagtgtcttttttgcttggcaacttactcaggcaaaacaagtcttagcagagggtaaagtgaaggtggtgacaactttctaccctgtttatgaatttacaaaaggggttattggtaatgatggcgatgtttccatgcttatgaaagcaggaacggaacctcatgattttgagccttctacaaaagacattaaaaaaatccaagatgcagatgcatttgtttatatggatgacaatatggaaacttgggtttctgatgtgaaaaaatcattgacatctaaaaaagtgaccatcgtcaagggaactggtaacatgctcttggtagcaggagctggacatgaccatcaccatgaggatgctgacaaaaagcatgagcataataaacatagcgaagaaggacacaaccatgcttttgacccacacgtgtggttgtcaccataccgtagcattacggtcgttgaaaatattcgcgacagtctttcaaaagcttacccagaaaaagcagagaacttcaaagccaatgccgctacttatattgaaaaattaaaagagcttgacaaagactatacggcagcactttcagatgctaagcaaaagagctttgtgacacaacacgcagcttttggttatatggcacttgactatggcttgaaccaaatttctattaatggtgtcacaccagatgcagaaccatcagcaaaacgtattgctactttgtcaaaatacgttaaaaaatatggcatcaaatacatttattttgaggaaaatgcgtcaagtaaagtcgcaaaaaccctagctaaagaagcaggagttaaagcggctgtgcttagtccgcttgaaggtttgactaaaaaagagatgaaagctggccaagattactttacggtcatgcgtaaaaaccttgaaaccttacgcttaaccactgatgtggctggtaaagaaattcttccagaaaaagacacgactaagacagtttacaatggttatttcaaagacaaagaagtcaaagatcgtcaattatctgactggtcaggtagctggcaatctgtttacccctatttacaagatggtactttagaccaagtttgggactataaggctaaaaaatctaaaggtaaaatgacagcagccgagtacaaagattactacactactggttataaaactgacgtggaacaaatcaaaatcaatggtaagaaaaagaccatgacctttgttcgtaatggtgaaaagaaaaccttcacttacacatacgccggcaaagaaatcttgacctatccaaaaggaaatcgcggagttcgtttcatgtttgaagctaaagaaccaaatgctggcgaattcaaatacgttcaattcagtgaccatgccattgctcctgaaaaagcagagcatttccacctgtactggggtggtgacagccaagaaaaattacataaagagttagaacattggccaacttactacggttcagacttatctggtcgtgaaattgcccaagaaatcaatgctcattaa

SEQ ID NO: 639 - DNA, 1125 bp, Streptococcus pyogenes MGAS8232
atgaaaaaatttcatcgttttttggtctcaggagtaatccttttaggttttaatggtctagtacctactatgccatctacacttatttcgcaacaggaaaatcttgttcatgcagctgttttaggcgataactatccgagtaagtggaaaaaaggcaatggaatcgattcgtggaacatgtatatccgccaatgcacttcttttgcagcttttcgtttaagctctgctaatggttttcagttacctaaaggctacggtaatgcctgcacgtggggacatatcgcgaaaaatcagggttatcctgtgaataagacaccaagcataggggctatcgcttggtttgataaaaacgcttatcagtcaaatgctgcttacgatcatgtagcatgggtagctgatatccgtggagacactgtcactatcgaagagtataattacaacgctggacaaggccctgaaagataccataagcgtcaaattccaaaatctcaggtaagtggttatatccattttaaagacttatcatctcagacaagtcattcctacccaagacaactaaaacacatttctcaagcttcatttgacccctctggaacttatcactttacaaccagattaccagtcaaaggacaaaccagtatcgatagccctgatcttgcttactatgaagcaggtcaatctgtttattacgataaagtcgtgactgctggaggttatacatggcttagctacctcagtttttctggaaaccgacgctatattcccattaaagagcccgcacagtctgtggttcaaaatgacaatacaaaaccttccattaaggtcggtgatactgttaccttccctggcgtttttcgtgtagatcagcttgttaataatttgatcgttaataaagaattagccggaggagacccaactccactaaactggattgatcccacaccattagatgaaacagataaccaaggaaaagttttaggaaatcaaattctccgtgtgggtgaatattttaccgtcactggtagttataaagtattaaaaattgatcaaccaagtaatggtatttatgttcaaatcggatctcgtggaacatgggtaaatgctgataaagctaacaaattatag

SEQ ID NO: 640 - DNA, 162 bp, Streptococcus pyogenes MGAS8232
atgttaaaatttacttcaaatattttagctactagtgtagctgaaacaactcaagttgctcctggaggctgctgttgctgctgtactacttgttgcttctcaattgctactggaagtggtaattctcaaggtggtagcggaagttatacgccaggtaaataa

SEQ ID NO: 641 - DNA, 1488 bp, Streptococcus pyogenes MGAS8232
atgggagaatcttattctgttgaagcggttttgacagctgttgataaaacctttggcaaaacattacaatcggcaatccgttcaatcgaaggcttggaaaagcgttcaaccggtttttcatcggtgtctcaaaaagctagttccatgtttaaatccatgttaggagcgaatttagctggacaagctatctcggcaatgacaaggacagtgtcatcaggccttggctctatgcttggcgagatgaatagttcagcgaaagcgtggaaaacttttgacgctaatttagcggacattgggtttggaaaaaaacaaattttggcagttaaaacggcgatgcaagactatgcaactaaaacaatctactcggcatcagatatggctagcacgtatgcacagttagcagcagttggcgtgaaagataccggaaagctcgtaaaagcttttggcggtttagctgcatctgctgaaaatccgaagcaggctatgaaatcaattagtcagcaaatgacacaagctgttggaagaccaacagttgcatggcaagactttaggataatgttggaacagacgcctgcagggatggctaaagtcgctaaatctatgggtaaaaatcttgatgaactcgtcgccgatatccaggcgggtagggttaaaaccagcgattttttggaagcggtaaaaaaagcaggcaatgataagagtttccaaaagatggcaactgagttcaaaactgttgaccaagccatcgacggtatgcgagaaggcttatccaacaaattgcaaccagcgtttgaaaaagtgaaccaatttggaattagagcgatcgaagcaatcggtaaacaactcgataaagttgatttttctaagtttgctagtaatcttgggaaattccttgaaggaattaatatcgataaaattgtatctaatatttcatcggcggtttcatctgtcacttcaaaggttaaagaattttgggacggtttcaaacaaactggagcaattagtgctttttcaggagctttgcagagcgtttggggagctttaaaaaatgtcgctagcgccatgagcggagggaattggaagacttttggagcaacagttggagggattgttaaacacgtctctaacttcgctaaagctgtttccgatgttttaggaaagatggaccctggcagactaagaagttggatagctaccttcgccgcagtagctggaggttttaagttattcgaaaaattaacgggacaaagcgtcattggttcttttttggataaaattggcagcaaatttggtctctttggaaacaaagccaaagaaggaacagacaaagcctctaacggcgctagaagaagcggtggcattattagccaaatcttcagcggcttgggtaatatcgttaagtctgctggtacagccatatcaacagctgcaaaaggtatcggagttggtattaaaactgctttgtctggaatccccccctatcattag

SEQ ID NO: 642 - DNA, 921 bp, Streptococcus pyogenes MGAS8232
atgaaaaaaggtttttttctcatggttatggtcgtgagtttagtaatgatagcagggtgtgataagtcagcaaaccccaaacagcctacgcaaggcatgtcagttgtaaccagcttttacccaatgtatgcgatgacaaaagaagtatctggagacctaaatgatgtgaggatgatccaatcaggtgcaggcattcattcctttgaaccgtctgtaaatgatgtagcagctatttatgacgcggatttgtttgtttaccattcacataccttagaagcttgggcaagggatctagaccctaatttaaaaaaatcaaaggttgatgtgtttgaagcgtcaaaacctttgacactagatagagtcaaagggctagaagatatggaagtcacacaaggcattgaccctgcgacactttatgacccacatacctggacggatcccgttttagctggtgaagaagctgttaatatcgctaaagagctaggacgtttggatcctaaacacaaagacagttacactaaaaatgctaaggctttcaaaaaagaagcagagcaactaactgaagaatacactcaaaaatttaaaaaggtgcgctcaaaaacattcgtgacgcaacacacggcattttcttatctggctaaacgattcggcttgaaacaacttggtatctcgggtatttctccagagcaagagccctctcctcgccaattgaaagaaattcaagactttgtcaaagaatacaacgtcaagactatttttgcagaagacaatgtcaatcccaaaattgctcatgctattgcgaaatcaacaggagctaaagtaaagacattaagtccacttgaagctgctccaagcggaaacaagacatatctagaaaatcttagagcaaatttggaagtgctctatcaacagttgaagtaa

SEQ ID NO: 643 - DNA, 4944 bp, Streptococcus pyogenes MGAS8232
gtggagaaaaagcaacgtttttcccttagaaaatacaaatcaggaacgttttcggtcttaataggaagcgttttcttgatgatgacaacaacagtagcagcagatgagctaagcacaatgagtgaaccaacaatcacgaatcacactcaacaacaagcgcaacatctcaccaatacagagttgagctcagctgaatcaaaatctcaagacacatcacaaatcactcccaagacaaatcgtgaaaaagagcaaccacaaggtctagtctctgagccaaccacaactgagctagctgacacagatgcagcaccaatggctaatacaggtcctgatgcgactcaaaaaagcgcttctttaccgccagtcaatacagatgttcacgattgggtaaaaaccaaaggagcttgggacaagggatacaaaggacaaggcaaggttgtcgcagttattgacacagggatcgatccggcccatcaaagcatgcgcatcagtgatgtatcaactgctaaagtaaaatcaaaagaagacatgctagcacgccaaaaagccgccggtattaattatgggagttggataaatgataaagttgtttttgcacataattatgtggaaaatagcgataatatcaaagaaaatcaattcgaggattttgatgaggactgggaaaactttgagtttgatgcagaggcagagccaaaagccatcaaaaaacacaagatctatcgtccccaatcaacccaggcaccgaaagaaactgttatcaaaacagaagaaacagatggttcacatgatattgactggacacaaacagacgatgacaccaaatacgagtcacacggtatgcatgtgacaggtattgtagccggtaatagcaaagaagccgctgctactggagaacgctttttaggaattgcaccagaggcccaagtcatgttcatgcgtgtttttgccaacgacgtcatgggatcagctgaatcactctttatcaaagctatcgaagatgccgtggctttaggagcagatgtgatcaacctgagtcttggaaccgctaatggggcacagcttagtggcagcaagcctctaatggaagcaattgaaaaagctaaaaaagccggtgtatcagttgttgtagcagcaggaaatgagcgcgtctatggatctgaccatgatgatccattggcaataaatccagactatggtttggtcggttctccctcaacaggtcgaacaccaacatcagtggcagctataaacagtaagtgggtgattcaacgtctaatgacggtcaaagaattagaaaaccgtgccgatttaaaccatggtaaagccatctattcagagtctgtcgactttaaaaacataaaagatagcctaggttatgataaatcgcatcaatttgcttatgtcaaagagtcaactgatgcgggttataaagcacaagacgttaaagataaaattgctttaattgaacgtgatcccaataaaacctatgacgaaatgattgctttggctaagaaacatggagccctgggagtacttatttttaataacaagcctggtcaatcaaaccgctcaatgcgtctaacagctaatgggatggggataccatctgctttcatatcgcacgaatttggtaaggccatgtcccaattaaatggcaatggtacaggaagtttagagtttgacagtgtggtctcaaaagcaccgagtcaaaaaggcaatgaaatgaatcatttttcaaattggggcctaacttctgatggctatttaaaacctgacattactgcaccaggtggcgatatctactctacctataacgataaccactatggtagccaaacaggaacaagtatggcctctcctcagattgctggcgccagccttttggtcaaacaatacctagaaaagactcagccaaacttgccaaaagaaaaaattgctgatatcgttaagaacctattgatgagcaatgctcaaattcatgttaatccagagacaaaaacgaccacctcaccgcgtcagcaaggggcaggattacttaatattgacggagctgtcactagcggactttatgtgacaggaaaagacaactatggcagtatatcattaggcaacatcacagatacgatgacgtttgatgtgactgttcacaacctaagcaataaagacaaaacattacgttatgacacagaattgctaacagatcatgtagacccacaaaagggccgcttcactttgacttctcgctccttaaaaacgtaccaaggaggagaagttacagtcccagctaatggaaaagtgactgtaagggttaccatggatgtctcacagttcacaaaagagctaacaaaacagatgtcaaatggttactatctagaaggttttgtccgctttagagatagtcaagatgaccaactaaatagagtaaacattccttttgttggttttaaaggacaatttgaaaacttagcagttgcagaagagtccatttacaggttaaaatctcaaggcaaaaccggtttttactttgatgaatcaggtccaaaagacgatatctatgtcggtaaacactttacaggactcgtcactcttggttcagagaccaatgtgtcaaccaaaacgatttctgacaatggtctacacacacttggtacctttaaaaatgcagatggcaaatttatcttagaaaaaaatgcccaaggaaaccctgtcttagccatttctccaaatggtgataacaaccaagattttgcagccttcaaaggtgttttcttgagaaaatatcaaggcttaaaagcaagtgtctaccatgctagtgacaaggaacacaaaaatccactgtgggtcagcccagaaagctttaaaggagataaaaactttaatagtgacattagatttgcaaaatcaacgaccctgttaggcacagcgttttctggaaaatcgttaacaggagctgaattaccagatgggtattatcattatgtagtgtcttattacccagatgtggtcggtgccaaacgtcaagaaatgacatttgacatgattttagaccgacaaaaaccggtactatcacaagcaacatttgatcctgaaacaaaccgattcaaaccagaacccctaaaagaccggggattagctggtgttcgcaaagacagtgtcttttatctagaaagaaaagacaacaagccttatacagttacgataaacgatagctacaaatatgtctcagtagaagacaataaaacatttgtggagcgacaagctgatggcagctttatcttgccgcttgataaagcaaaattaggggatttctattacatggtcgaggattttgcagggaacgtggccatcgctaagttaggagatcacctaccacaaacattaggtaaaacaccaattaaacttaagcttacagacggtaattatcagaccaaagaaacgcttaaagataatcttgaaatgacacagtctgacacaggtctagtcacaaatcaagcccagctagcagtggtgcaccgcaatcagccgcaaagccagctaacaaagatgaatcaggatttctttatctcaccaaacgaagatgggaataaagacttcgtggcctttaaaggcttgaaaaataacgtatataatgacttaacggttaacgtatacgctaaagatgaccaccaaaaacaaacccctatctggtctagtcaagcaggcgctagtgcatcagctattgaaagtacagcctggtatggcataacagcccgaggaagcaaggtgatgccaggtgattatcagtatgttgtgacttatcgtgacgaacatggtaaagaacatcaaaagcagtacaccatatctgtgaatgacaaaaaaccaatgatcactcagggacgttttgataccattaatggcgttgaccactttactcctgacaagacaaaagcccttggctcatcaggcattgtccgcgaagaagtcttttacttggccaagaaaaatggccgtaaatttgatgtgacagaaggtaaagatggtatcacagttagtgacaataagatgtatatccctaaaaatccagatggttcttacaccatttcaaaaagagatggtgtcacactgtcagattattactaccttgtcgaagatagagctggtaatgtgtcttttgctaccttgcgtgacctaaaagcggtcggaaaagacaaagcagtagttaactttggattagacttaccggtccctgaagacaaacaaatagtgaactttacttaccttgtgcgggatgcagatggtaaaccgattgaaaacctagagtattataataactcaggtaacagtcttatcttgccatacggcaaatacacggtcgaattgttgacctatgacaccaatgcagccaaactagagtcagataaaatcgtttcctttaccttatcagctgataataacttccaacaagttacctttaagatgacgatgttagcaacctctcaaataactgcccactttgatcatcttttgccagaaggcagtcgcgttagccttaaaacagctcaaggtcagctgatcccgcttgaacagtccttgtatgtgcctaaagcttatggcaaaaccgttcaagaaggcacttacgaagttgttgtcagcctgcctaaaggctaccgtatcgaaggcaacacaaaggtgaataccctaccaaatgaagtgcacgaactatcattacgccttgtcaaagtaggagatgcctcagattcaactggcgatcataaggttatgtcaaaaaataattcacaggctttgacagcctttgccacaccaaccaagacaacgacctcagcaacagcaaaagccctaccatcagcgggtgaaaaaatgggtctcaagttgcgcatagtaggtcttgtgttactcggacttacttgcgtctttagccgaaaaaaatcaaccaaagattga

SEQ ID NO: 644 - DNA, 1392 bp, Treponema pallidum subsp. pallidum str. Nichols
atgatgcggtcacttttttcaggtgtgtctggtatgcagaatcatcaaacgcgcatggatgtcattgggaacaacgtcgcgaacgttaacactaccggttttaagcgtgggcgtgttaattttcaagatcttatttctcagcaactgagtgcggctgcgcgtccgaatgaagaagttggaggagtgaatcccaaggaagtgggattgggcgtgctgattgcaagcatcgatactgttcacacgcaaggtgcactgcaaacgacgggtatcaatacggatgtgtctattcaggggagtggtttttttgtgctgaaaagtggggaaaagacgtttttcacccgcgcaggtgcctttggggttgataatgcgggcactctcgtgaaccctgcgaatggtatgcgcgttcaaggttggatggcgcaggacgtggcgggggagcgtttaattaattcctctgcacagacgcaggatctcgttatccccattgggcaaaagatagatgcgcagcagaccagcactgttcactatgcctgtaatttagacaagcgtctgcctgagcttgctgcagatgcgaacgaagcggacgtgcgtaagtccacgtggacaactgactttcaagtgtatgatagcttcgggcagcagcatacgttgcagattaacttttcgcgtgtgccggggacgaacaatcagtggcaggccactgtcgcagtggatccggggacagaggtagatacgcaaacgcgtgtaggggtggggacatctgacggtgcggcaaacacctttattgtaaattttgataattttggacacctcgcttcagtgactgacactgcagggaacgtgaccggtcctaccggacaggtgctccttgaagcgtcgtacgatgttgtcggtgcgaatccggacgatgcagggcaggttacgcgccacgctttcacgctcaacttgggtgaaattggcaccgcgcgcaatacgattacgcagtttgctgaacgcagtactaccaaagcctaccggcaggacggttacgcgatgggatatttggaaaattttaaaatagatcaaagcggtgtcatcactggtgtgtattcaaatggggtgagccaagacattggccagctcgcacttgcaggatttgcaaatcaaggtggtcttgagaaggcaggagagaacacctacgtacaatcgaacaactcagggatagcgaacattagcacgtcgggggtgatggggaagggaaagttgattgcagggacacttgagatgagcaacgtagatttaaccgatcaatttacggatatgatcattacccaaaaagggtttcaggcgggcgcaaagacgattcagacatcagacaccatgttggatacggtgttgagtttgaagcgctga

SEQ ID NO: 645 - DNA, 2277 bp, Treponema pallidum subsp. pallidum str. Nichols
atggggtgcatgcggtgggggagtgtgctgtgtgtggtggtgggggtaggagcgagcgggggagtgctcggacaggagttttccccgaagctaactggctctgccacacttgagtggggcatcagctatggcaagggggtaggcagtcatggccaggcccctggtgcagttatgggcaccggtccctacaatctgaagcacgggtttcgtactaccaacacggtgggagtatcctttcccctggttatgcgcaccacccacacgcgccgtgggcagcacccggcactgtatgcggagctgaaggtggcggacctgcaggcggacctgagtcaggggaaggcaggttttgccgttaagcgcaaggggaaggtagaggcgacactacactgttatggggcctacctgacgattgggaagaaccccacgtttctgacgaactttgcccggctgtggaagccgtgggtgacagcgcagtaccaggaggatgcggtacagtatgcgccggggtttgggggtttaggcggcaaggttgggtatcgggcacaggacattgggggcagtggggtcagccttgatgtggggtttctctcctttgcctctaacggtgcctgggatagtactgaccccacgcacagtaagtatggctttggggcagacttgaagctaatgtatgcgcgtgcaggacaccctctgtgcacggtagagcttgccagcaatgttacgctagaagacggatacctcatcggtgcacagaaggacgcaaacaatcagaacaaggataaactgctgtggaatgtagggggccgactcaccctcgaaccaggcgccggcttccgcttctccttcgccctcgacgccggtaaccaacaccagagtgcacaggactttcaaaatcgcacacagagggcgcagagtgaactcaccgccctctcaaataacctcttccagggagaaagtcaaaaacaggaagcctgggtaacccaggtagtgcaacaggcgacgcagacagtaacggctggagttcgaagcgcgctggaatctcgggggactacgtacataaacgcgctagaggcagttcagcctaatcctgctaaacctaccggtaaggttgtgcaaaatcttcacaccccgcagggaagtccgccgaacctgccgccgcttcctgcacttcctgcattttccctgatggggcaggttttgctgcagtacgatgcggagcaggtggtgaaggggtttgagcaggtacagacgcaaatcgtcactgaaattaatcagaaagtgcaagcggctgtggcaaaaaataatgcaaacatgcaagcggtcgggggtagtctaggcgatactgcgagaatggtaggcgaagcgctcattaagcagcaactatcacgtaagcagaacagcattctgaccatggtgagcgtgcaagatgaggtgaaacaggatctggcagatttagtgccgatgatgcgaacggaaataacggcgtttttcgcgagtgtccagcaacacataaccgaagaagtgaagaagaagacggatgcgttgaatgcggggcagcagatacgtcaggctatacagaacctgcgtgcgtctgcatggcgtgcctttctaatgggagtcagcgccgtgtgtctgtatcttgacacctacaatgtcgccttcgatgcgctgtttacggcgcagtggaagtggctgtcttctggcatatactttgccacagcaccggcaaacgtttttggcaccagggtgttagataacaccatcgcaagctgtggcgactttgccggattccttaagctcgaaactaagagcggtgacccctacacccacctgctcaccggcctggacgccggcgttgaaacacgcgtgtacatccccctcacccatgacctgtacaaaaataataacgggaaccctctcccttccggcggttcctcagggcacattggcctgccggtggtggggaaggcgtggtgtagctatcgcatcccggtgcaggattacggctgggtgaagccaagcgttacggtccatgcctctaccaaccgtgcacacctgaatgcccctgctgcaggtggagcagtaggagctacctatctaaccaaggagtactgtgcacagctgcgtgctggtatttcagccagtctcatagagaagacggtattctcccttgattgggaacagggtatgctctctgatgtcccgtacctgctggtgtccgagtgcctcacccagggaatcggccgcatcgtgtgcggcgtcaccctctcctggtag

SEQ ID NO: 646 - DNA, 1797 bp, Treponema pallidum subsp. pallidum str. Nichols
gtgggcaggcaggtgatgcaagcgggggtacttgcgggcatggtatgtgctgcttctggttatgcaggcgtactcactccgcaggtcagtggcacagcccagctccagtggggcattgcgttccagaagaatccacgcactggcccgggcaagcacacccatgggtttcgcactaccaatagtctgactatttccctgccgttggtgtcaaagcacacccacacccgccgaggggaggcacgctcaggggtgtgggcacagctgcagctgaaggacctggcagtagagcttgcgtcttctaaaagctcaacggccctgtcctttaccaaacctaccgcttccttccaggcaaccctgcactgttatggggcctacctgacagtgggtaccagtccttcctgtgtggttaactttgcccagctgtggaaaccctttgtcacccgtgcctattcagaaaaggacactcgctatgcccctggtttctccggctccggggcaaaactcggctaccaggcccacaatgtgggaaacagcggagtagatgtggacatcggtttcctctccttcctttccaatggtgcctgggatagtactgacaccacgcacagcaagtatggcttcggggccgatgcaacgctttcctatggcgtcgaccgtcagcggctgcttacgttggagctggcagggaatgccacactggaccagaactacgttaagggtaccgaagactccaagaacgaaaacaaaacagcactcctgtggggagtaggaggccgactcaccctcgaaccaggcgccggcttccgcttctccttcgccctcgacgccggtaaccaacaccagagtaacgcacatgctcagacccaagagagagctatcctcaaagcaagggaagtgtttagacgggtggaggggaaactcgtgcagaaccttcccaatatcatgatgccaccaggaatcaccgaacaaaccactctcatagagatggtaggacttgctgctttgattgcagaaggaacgctcggcagcgccattcaaaccgtgctagccgctggcgcgctcgcggcgcttgtatcgcaacttgtaccgaacatagagcaaggagtacgtgatgtcttccgctcttccgatccaagagttgtcactgctaaacttctcgctttccttgagcgcgcacctatgaacgcgctcaacatagacgcgctcctgcgtatgcagtggaagtggctctcttctggcatatactttgccaccgcaggcactaatatctttggcaaacgcgtctttgctaccactcgtgcgcactactttgattttgccggattccttaagctcgaaaccaaaagcggtgacccctacacccacctgctcaccggcctgaacgccggcgtcgaagcacgcgtgtacatccccctcacctacatccgttacagaaataacggagggtacgaactgaatggagctgtgccccctgggactatcaatatgccaattttggggaaggcgtggtgcagctatcgcatccccctcggttcccacgcctggcttgcaccacacacatccgtgctcggcacaaccaatcgctttaacattattaaccccgcgggcaacctgttgaatgaacgagcgctccagtaccaggtgggactgacgttcagtcccttcgagaaggtggagctcagcgcccagtgggaacagggcgtgcttgctgacgctccttacatgggcattgccgagagcatctggtccgaacgccacttcggcacccttgtctgcggaatgaaagtgacatggtaa

SEQ ID NO: 647 - DNA, 1797 bp, Treponema pallidum subsp. pallidum str. Nichols; identical to SEQ ID NO: 646

SEQ ID NO: 648 - DNA, 3768 bp, SARS coronavirus Frankfurt 1
atgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgattttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataa

SEQ ID NO: 649 - DNA, 3768 bp, SARS coronavirus HSR1
atgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataa

SEQ ID NO: 650 - DNA, 3768 bp, SARS coronavirus ZJ01
atgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgttatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataa

SEQ ID NO: 651 - DNA, 3768 bp, SARS coronavirus TW1; identical to SEQ ID NO: 649

SEQ ID NO: 652 - DNA, 3768 bp, SARS coronavirus CUHK-Su10; identical to SEQ ID NO: 649

SEQ ID NO: 653 - DNA, 3768 bp, SARS coronavirus Urbani
atgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagctcgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataa

SEQ ID NO: 654 - DNA, 3768 bp, SARS coronavirus
atgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgcgcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataa

SEQ ID NO: 655 - DNA, 3768 bp, SARS coronavirus TOR2; identical to SEQ ID NO: 654

SEQ ID NO: 656 - DNA, 3768 bp, SARS coronavirus GD01
atgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttgacaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacccatttttaagttgcctcttggtattaacattacaaattttagagccattcttacagcctttttacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaagagatgttgtgagattccctaatattacaaacttgtgtccttttggagaggtttttaatgctactaaattcccttctgtctatgcatgggagaggaaaagaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttatgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaagattttggtggttttaatttttcacaaatattacctgaccctctaaagtcaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgcggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataa

SEQ ID NO: 657 - DNA, 3768 bp, SARS coronavirus CUHK-W1
atgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttgacaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataa

SEQ ID NO: 658 - DNA, 3768 bp, SARS coronavirus BJ01; identical to SEQ ID NO: 657

SEQ ID NO: 659 - DNA, 4767 bp, Escherichia coli 0157:H7
atgaacaaaatatttaaagttatctggaaccctgcgacagggaattatactgttaccagcgaaacggcaaaaagccgtggcaagaaatctgggcgcagtaagctgttaatttctgcgctggttgcgggtggaatgttgtcgtcgtttggggcattggcgaatgccgggaatgacaacggtcagggtgttgattacggtagtggatcagctggcgacggctgggttgctataggcaaaggggcgaaagcaaatacttttatgaacaccagtggttccagtactgctgtgggttatgacgctatagctgaaggccaatatagctctgccatcgggtcaaaaacccatgcgattggtggtgcatcaatggcctttggggttagtgcaatatcagaaggcgatagaagtatagcactgggtgcctcttcgtattcattgggccaatactcaatggccctcggccgttattcaaaagcattgggtaaattgtctattgctatgggggactcttccaaagcggaaggagcaaacgccattgccctgggaaatgccactaaagctactgagattatgagtattgctcttggcgacaccgccaatgcgtcaaaagcgtattcaatggcgctgggagcaagtagcgtcgcatctgaagaaaacgctattgcgataggtgctgagaccgaagccgctgaaaatgcaactgctattggcaataatgcgaaggcaaaagggactaatagcatggcaatggggttcggaagccttgccgataaagtcaatactatcgcattaggaaatggcagccaggctctggcagataatgcaatcgccataggccagggcaacaaagctgatggcgtggatgccatcgctctgggtaatggtagccagtcgagaggcttaaacaccattgccttaggcacagccagtaatgcaactggtgataagagtcttgcgcttggtagtaatagcagtgccaacggtattaactctgtcgcgctgggcgcagattccattgcggatttagacaataccgtctctgtcggcaatagttcattaaaacgcaagatcgttaatgtgaaaaatggcgcgatcaagtctgacagttacgatgccattaatggttcacagctttatgccattagcgactcggtagcaaaaaggcttggaggaggggctgcagtagatgttgatgacggtactgttacagcaccaacctacaatttaaaaaatggtagcaaaaataacgtaggggctgcgctcgctgtacttgatgaaaacaccctgcaatgggaccaaaccaaaggcaaatacagcgctgctcatggtactagtagcccaactgccagcgtaatcaccgatgttgcggatggcacgatttcagcctccagtaaggatgcggttaacggttcccaactgaaagctaccaatgacgatgtcgaagccaacaccgccaatatcgctactaataccagcaacattgccacgaatacggcaaatattgccaccaataccaccaatatcaccaacctgacggattccgttggtgaccttcaggctgatgccctgctctggaacgaaactaaaaaggcattcagtgcagctcacggccaggataccaccagcaaaatcaccaacgttaaagatgccgacctgacggctgacagcactgatgctgttaacggctctcagctgaaaaccaccaacgatgctgtggcgacgaataccaccaatatcgccaataacacttccaatattgccactaacaccaccaacatctctaacctgactgagacggtgactaatcttggtgaggatgcgctgaaatgggataaggacaatggtgtattcacggcagctcatggcaccgagaccaccagcaaaatcaccaacgttaaagatggcgacctgacgactggcagcaccgatgccgttaacggctctcagctgaaaaccaccaacgatgccgtggcgacgaataccaccaatatcgccactaacaccaccaacatctctaatctgactgagacggtgactaatcttggtgaggatgcgctgaaatgggataaggacaatggtgtcttcactgcagctcatggcaacaataccgccagcaaaatcaccaatatcctggacggcacagtcactgcaaccagttccgatgccattaacggtagccagctttatgacttaagcagcaatatcgccacctacttcggcggcaatgcttctgtgaatactgacggtgtgtttaccggtccaacctacaaaatcggtgaaacaaattattataacgtcggcgatgcactggctgcgattaactcctcatttagcacgtctctcggcgatgctctgctttgggatgccaccgcaggtaaattcagtgccaaacacggtactaatggtgacgcaagcgtgatcactgatgtcgcagatggtgaaatttcagactccagttctgacgcagtaaacggctcacaactccacggcgtgagcagttatgttgttgatgcgctggggggtggtgccgaagtcaatgcagacggcaccatcactgcgccgacgtacaccattgctaatgctgattacgataatgtcggtgatgccctgaatgctatcgataccactcttgacgacgctctgctctgggatgcggacgccggtgaaaatggtgcatttagcgccgctcacggaaaagataaaactgccagtgtaatcactaacgtcgctaacggtgcaatctctgctgccagcagcgacgcgattaacggctcacaactctataccaccaataagtacatcgctgatgcgctgggtggtgacgcagaagtcaacgctgacggcaccatcaccgcaccgacttacaccattgcgaacgccgagtacaacaacgtcggtgacgccctggatgcgcttgatgataacgccctgctgtgggatgagactgccaatggcggtgctggagcctacaatgccagccatgacggtaaagccagcatcatcactaatgtcgctaatggcagtattagtgaggacagtaccgatgcagtgaacggttctcagttgaatgcgacgaatatgatgattgagcagaacacccaaattatcaatcagctcgctggtaacaccgacgcaacctatatccaagaaaacggtgcgggtattaactatgtgcgtactaacgacgacggcttagcgttcaacgacgccagcgcacagggtgttggcgctacagctataggttataactctgtcgccaaaggcgatagcagcgtagctattggtcagggcagctacagcgacgttgatacgggtatcgccctgggtagcagctctgtttccagccgagtgattgccaaaggctcccgtgacaccagcataacggaaaatggcgttgttattggttacgacaccacggatggcgaactgctcggtgcattgtctatcggtgatgacggtaaatatcgtcaaatcatcaacgtagccgatggttccgaagcccatgacgccgttacggttcgtcaattgcagaatgcgattggtgcggtcgcaaccacgccgactaaatacttccacgctaattcaacggaagaagattcactggcagtgggaactgactcgctggcaatgggtgcgaaaaccatcgtgaatggcgataaaggtattggtatcggttatggtgcctacgtggacgcgaatgcacttaacggcattgccattggtagcaatgcgcaagtcattcatgtcaacagtattgcgataggtaatggttctacgaccactcgtggcgctcaaaccaattataccgcctacaacatggacgcaccgcagaactctgtcggtgaattctcagtcggtagtgcggatggtcaacgtcagatcactaacgtcgcagcaggttcggctgataccgatgcggtcaacgtgggtcagttgaaagtaacggatgcgcaggtttcccagaatacccagagcattactaacctggataatcgggtaacgaatcttgattcacgcgtcaccaatatcgaaaacggtattggcgatatcgtcaccaccggtagcaccaagtacttcaagaccaataccgatggtgtagatgccagcgcgcagggtaaagatagcgtcgcgattggttccggctccattgctgccgctgacaacagcgtcgctctgggtacagggtctgtggcaaccgaagaaaatacgatctctgtaggttcctctactaaccaacgtcgtatcaccaacgtagctgcaggtaaaaatgctaccgatgctgttaacgtggcacagttgaagtcttccgaagctggcggtgtacgttacgacaccaaagctgatggttctatcgactatagcaatatcaccctcggtggcggcaacggcggtacgactcgtatcagcaacgtctccgctggcgtcaacaacaacgacgtggtgaattacgcgcagttgaagcaaagcgtgcaggaaacgaagcaatacaccgatcagcgaatggttgagatggataacaaactgtctaaaactgaaagcaagttgagcggtggtatcgcttctgcaatggcaatgaccggtctgccgcaggcttacactccaggtgccagcatggcctctattggtggcggtacttacaacggtgaatcggcagttgctttaggtgtatcgatggtgagcgccaatggtcgttgggtctacaaattacaaggtagtaccaatagccagggtgaatactccgccgcactcggtgccggtattcagtggtaa

SEQ ID NO: 660 - DNA, 15876 bp, Escherichia coli 0157:H7
gtgccagcttccgcagtaggtgcgctgggcgaagccagctacacggtgacggcgaacgtcaccgacagcgcaggcaacagcaattccgccagccataacgtgcaggtcaataccgcgctgcctggcgtcaccattaacccagttgcgaccgacgatattattaacgccgccgaatcgggcaatgcgcaaaccatcagcggccaggtgacgggggcggcggcgggcgatacggttaccgtaacgcttggcgggaaaacttacaccgctaccgtgcaggggaatttaagctggagcgtggacgttccggcggcggatattcaggccatcggcaatggcaatctgacggttaacgcttcggtgaccaacggcgttggcaatactggcagcggttcgcgagatattactatcgacgccaacctgccaggtctgcgcgttgacaccgtggcgggcgatgatgtggtcaatagcatcgagcacgctcaggcgctggtgataactggtagcagcagcgggctggcggcgggcgcggcgctgacggtggtgattaacacggtcacttacgctgcaacagtattagccgatggcacatggagcgttggtgttccggcggcagacgtgagtaactggcctgcgggtacggtgaatatcacggtaagtggcactaacacagccggaacaacatccaccatcacccatccggtcaccgtcgatctggcggcggtggcgatttccattaacaccgtttccggcgacgatgtgattaacgccgccgaaaaaggggcagatttaaccctttccggcagcacctccggcgtggaagtggggcaaacggtcaccgttacctttggcgggaaaacctacaccgctaccgtagcgggcgatggtagctggacaaccaccgtacccgccgccgatctcagcgtgttacgcgacggcgacgccaccgtgcaggccagcgtcagcactattaacggcaacacggcttcggcaacccacgcctacagcgtcgatgccacggccccgacgcttgccattaacaccatcgccaccgacgatattctgaacgctgccgaggcgggcaatccgttaaccatcagcggtagcagcaccgccgaagcggggcagacggtaaccgtcacgcttaatggtgtgacttacagcggctccgtccaggcggacggcagctggagcgtcagcttaccgacggcggatctcagcaatctgaccgccagccagtacaccgttagtgcctcggtaagcgataaagcgggtaacccggcgtccgctaaccacgggctggcggtggatctcaccgtgccggtgctgaccatcaacaccgtctccggcgatgacattattaacgccgccgaacacggacaggcgctggtgatctccggctccagcactggcggcgaagcgggtgatgtcatcaccgtcacactaaacagtaaaacctacaccaccatgctggacgcttccggcaactggagcgtcggcgttccggcggctgacgtcactgcgcttggcagcggcccgcaaactatcactgcggcaattaccgacgcggcaggcaacagcgatgacgccagccgcacggtcaccgtgaatctcgccgcgccaaccattggtatcaacaccatcgccaccgatgacgtgattaaagccacggaaaaaggcgcggacctgcaaatcaccggcaccagtaatcagcctgcgggcaccaccattacggtgacgctgaacgggcaaaattacaccgctactaccgatagcaacggcaactggagcgccacggtgccagcgtcagcggttagcgcattgggtgaagccaactacacggtaacggcaaacgtcactgatacggcaggcaacagtaattccgccagtcataatgtgctggtcaacagcgccttgcctgccgttaccattaacgcggtggcgactgacgatattattaacgctgccgaatcgggaaatgcgcaaaccatcagcgggcaggtgacgggcgcagcgcagggggatacggttaccgttacgctgggcggcaacacctacaccgccacggtgcagtctaatttaagctggagtgtggacgttccggcggcggatattcaggcgctgggcaacggcgacctgacggttaatgcctcggtcaccaatggcgtcggcaacaccggcagcggctcgcgcgatatcacgatcgacgccaatctgcctggcctgcgggtcgataccgtggcgggcgatgatgttattaacagcattgagcacaatcaggcgctggtgatcaccggcagcagcagcggattaacggcgggaacggcgttaacggtcgagattaacaacgttacttatggcgcgacggtattagccgacggcacgtggagcctcggtgttccggcggtagacgtcagcaactggccagcgggtacggtgaatatcacggtaagcggcaccaacagtgccggaacaacctccaccattacccatccggttaccgtcgatctggctggggtcgccatcaccattaacactctctctggtgatgatgtgatcaacgccgtcgaaaaaggcgaaacgctggtcgtaagcggcagcaccagcggtgtcgaagccgggcagacggtgaccgtcacctttggcggcaaaaattacaccaccacagtggaagctaacggtagctggacggtgaatgtgccgcctgccgatctcgctgcgctaccggacggcgcgggcaacgtgcaggcgagtgtcagtaatattaacggcaacagcgcccaggccgatcgcgcgtatagcgttgatgccaccgcgccgcttgtgaccatcaacaccatcgccagcgacgatatccttaacgtgagcgaagctggcgcggggatcaccatcagcggcactaccacggcgcaggccgggcagacgctcaccgtcacgctcaataacaacacgtaccagaccaccgttctggcggatggcacctggagcgtgaatgttccggcagcggatttaagcggattaaccgccagcagttacaccgtgaccgccacggtgagcgacaaagcgggtaacccggcaagcgccgaccacgcgctggtggtagatatcactgcgccggatctcaccattaacaccgtcgcgggcgatgacattatcaacgccatcgaacatggtcaggcgttggtggtcagcggcaccagtacgggcgcggcggcgggtgatgtggtaaccgtcacgctgaacggtaaaaactacaccaccacgctggatgcctccggtaactggagcgtgggcattccggcggcggatgtcacggcgctggcgaccggtagccagaccatcaccgccagcctgagcgatcgcgcgggcaacagcgacagcacgactcacgatgtgaccgttgatcttagcggcccgacgctgaccattaacaccgtctccggcgatgacattatcaacgccgctgaaatcgttgtggcgcagaccatcagcggtcaggtcacgggaacggcggttgccgggaatacggtgattgtcaccattggcggcaatcaatataacgccaccgtgcagtcagatttaagctggagcgtcagcgtaccggcgaacgttttgcaggcgctgggtaacggtgaactgaccatcagcgcctcgttgaccaattccgcaaataataccggcaccgcgacgcacgatatcgtgatagatgccaacctgccaggtctgcgcgtcgataccgtggcaggcgatgatgtgattaacagcatcgagcacactcaggcgttggtgatcaccggtagcagtagcggactggcggcgggcgcggcgttgacggtggttatcaatagcgtcacctacggcgcaacggttttagcggatggtagctggagcgttggtgttccggtggcagatgtcacaaactggcctgcggggacggtcaatattgccgtctctggcaccaacaccgccggaaccacaaccagcattagccatccggtcacggtcgatctcgctgccgtggcgatcaccatcaacaccctttccactgacgatgtgattaacgccgccgagaaaggctctgatttgcagctctccggcaccacctccggcgtggaagcggggcaaaccatcaccgttatcttcggcggcaaaagctacaccaccacggttgccgcggataatacctgggggctgacgatccctgccgtcgatgttgcaaccttgccagacggcgcagcaaacgtccaggccagcgtcagcaatgtcgcagggaacagcacccaggcaacgcatgcttacagcgttgatgccactgcgccctccgttaccatcaacaccatcgccacggacgatattcttaacgccgccgaagcgggatcggcgctgaccatcagcggcaccagcacggcggaagccgggcagacggtgaccgtaacgctaaacggcgttaattacagcggcaatgtgcaggcagacgggagctggagcgtcagcgtaccaaccggcgatttagctagccttaccgccagctcgtataccgttaacgcctcggtcagcgacaaagccagaaattcggcttcggcaacgcataatctgacggtggaccttgccgctccggtcgtcaccatcaacacggtggcgggcgatgacatcattaacgccacggaacacggacaggcgcagatcatcagcggctcggcaacgggcgcgactaccggtaatacggtttccgtgacgattggcacgaccacctataccaccgtgctggacgccaacggcaactggagcatcggcgtgcctgccagcgtgatttccgcgctggcgcagggcgatgtgaccattaccgctacggtcaccgactccgcaggcaacagcggcacggcctcgcacactgtcaccgtggcgctcggcgctccggtgctcgccattaacaccattgccgtcgatgacatcatcaacgccgcggagaaaggcgcggatctggcgattaccggcaccagcaaccagcctgcgggcacgcagattaccgttacgctcaacgggcaaaattacaccaccactgccgatgcttccggtaactggagcgtgaccgttccggcgtcacgggtgagcgccctcggtgaagccacctacacggtgaccgcagccgccactgacgccgatggcaacagcggttccgccagccataacgtacaggttaataccgcgctgccgggcgtcaccattaacgtggtggcaacggacgatattattaacgccgccgaagcgggcgtggaacagaccatcagcgggcaggtgacgggtgcggcggcaggcgacacggtgaccgtcacgctcggcggggcgacttacactgccacggtgcaggcgaatttaagctggagcgtcgatgttccggcctccgcgctacaggagttgggcaacggcgaactgaccatttcggcttcggtgacgaacagcgtaggcaatactggtaacggcacgcgcgaaatcaccatagacgcgaatctccccggtctgcgggtcgacaccgtggcgggcgatgatgtggttaatattatcgagcacgggcaggcgctggtgattaccggcagcagctccggtctggcggcgggcagcaacgtcacgctgaccattaacgggcaaacctatgttgcggcggtgctggcggatggcacctggagcgtcggcgttccggcggtggatgtcagcgcctggcctgcgggatcggtgacgattgcggcgagcggtagcacctctgccggaaatccggtaagcgttacgcatccggtgacggtcgatctctcggcggtggcggtgagcatcaacgccattaccgccgatgatgtgatcaacgctgccgaaaaaggcgcggcgttaacgctctccggcagcacctctggcgttgaagccggacaaacggttaccgtcacctttggcggcaaaacttacagcgccacggtggctgcgaatggttcctggagcacctcggttccggcggcagatatggcggctctgcgtgatggcgatgccagcgcacaggccagcgtcagcaatgttaacggcaacagcgccaccacgacccacgcttacagcgttgatgccagcgcgccaacggtgaccattaataccattgcgggcgatgatattcttaacgccgccgaagccggagcggctctgaccatcaccggcagcagcacggcggaagcggggcagacggtgaccgtcacgctcaatggcacaaactacaccggcaccgtacagacggacggcagctggagcgtcagcgtaccgtcagccgacttaagcaccctgaccgccagcaactacaccgtgaacgcggcggtgagcgacaaagccggaaacccggcctcggttaatcacaacctgacggtggatacgtccgttccggtcgtcaccatcaacacggtggcaggcgatgatgtgatcaacgcgacggaacacgcccaggcgcagatcatcagcggctccgccactggagcggcaaccggtagcaccgtgacggtgactatcggcacaaatacctttaccacggtgctggatgccagcggcaactggagcgtcggcgttccggcaagcgtcgtctcggcactggcgaatggcacggtgaccatcaatgccagcgtcaccgatgccggaggaaacagcggcagcgctacccatcaggtgacggtcaataccgggctgccgaccattacctttaacgccatcagcggcgataacatcctgaacgccgatgaaaaaggccagccgttgaccatcagcggcggcagtacggggctggcgacgggcgcgcaggtcaccgtcacgctcaacggtcacaactacagcgccaccaccgacgcatcgggcaactggaccttaaccgtgccggtgagcgatctggcggcattaggtcaggccaactatacggtcagcgccagcgccaccagtgcagcaggcaacaccgccagcagccaggcgaatttactggtcgacagcggcctgccggacgtcaccatcaacaccgtggcaggcgacgatattatcaacgccgccgaagcgggggccgatcaaaccatcagcggggtggtgactcgcgccgccgctggcgatacggtcaccgtgacgctgggcgggaacacttacaccgctacggtacagagcaacttaagctggagcgtcagcgttccgacagccgatctccaggcgttgggcaatggtgatttgaccattaccgcctcggtcaccaacgctaatggcaacaccgggagcggcacgcgggatatcaccattgatgccaacctgccggggctgcgcgtagataccgtggcgggcgatgatatcgtcaacagcatcgagcacgggcaggcgctggtgatcaccggcggcagtagcggcctgaatgcaggtgctgtgctgacggttaccatcaacagtgtggcgtattccgccacggtgcaggcggacggaagctggagcgttggcattccggcggcaaacgtcagcgcctggcctgcggggccgttaaccgtggaggtagacgggcaaagcagcgccaataacccagtcagcgtcagccatccgttcaccgtcgatttaacggcggtggcaatcagcatcaacaccgttgccagcgacgacgtgattaacgccgcagaaaaaggcaccaatctgactctttccggcagtaccagcgggattgagagcgggcaaaccgtcaccgtcacttttggcggtaaaacctacactgcaagcgtcgccgccaacgggagctggagtgtaaacgttccggcggcagatctggcaactctgccagagggcgcggcgaatgtgcaggccagcgttagcagcgcgagcggtaacagtgcctcggcgacccatgcgtatagcgttgacgccagcgcgccgacgctcaccattaacaccatcgccagcgacgatatccttaacgccgcagaagccggaagcccgctcaccatcagcggcaccagcaccgccgaaaccgggcagacggtgaccgtcacccttaacggcgcaacctacaccggcactgtgcaggcggacggtagctggagcgtcagcgttcccacttcagccctgggcgcgctcaacgcaagcaattacaccgtcagcgccacggtcaatgacaaagcgggcaaccccggcagcgccagccataatctggcggtagacaccaccgcgccggttctcaccattaacaccgtggcgggcgatgacatcatcaacgatgccgaacatgcgcaggcgctggtgatctccggcaccagtagcggcggggaagcgggcgatgtggtgagcgttgtgctcaacggcaaaacctacaccaccaccctggatgcctccggcaactggagcgttggcgttccggcggcagatgttacggcgctgggtagcggtgcgcagaccatcaccgccagcgtcagcgatcgggcaggcaacagcgacgacgccagccgcaccgtgaccgtcagcctcagcgcgccagtgattagcatcaacaccatcgcgggcgatgatgtgatcaacgcgacggaaaaaggatctgatctggcgctttctggcaccagcgatcagcctgcgggtacggcgatcaccgtcaccctgaacggacaaaactacagcgccaccacggatgcctccggcaactggagtgttaccgtgcctgcctcggcggtcagtgcgctgggcgaagcgacctacagcgtgacggcgagcgtcaccaatgctcagggtaacagcagcaccgccagccataacgtgcaggttaataccgcgctgccgggcatcaccattaatccggtggcgacggacgatattatcaacgcttcagaggcaggcagcgcgcaaactatcagcggccaggtaaccggtgcggcggcgggcagcaccgtcaccgttgaactgggcggtaaaacttacaccgccaccgtccaggctgatttaagctggaatgtgagcgtacctgccgccgactggcaggctctgggtaacggtgagttaacggttaatgcctcggtgaccaacgccgttggcaacaccggtagcggcacgcgcgatatcaccatcgatgccagtctgcctggcctgcgggtggataccgtcgcgggtgatgatgtggtcaatatcatcgaacacgctcaggcgcaggtgatcaccggcagcagctccggctttgccgcaggcacggcgttgacggtggtgattaacaaccaaacttacgccgccacggtgttggcgaacggtagctggagcgtcggcgttcctgcgacggatgtcagtaactggcctgcgggaacgctgaatattaccgttagcggggcgaacagtgccggaacgcaaaccagcattacccatccgctgactgttgatctcaccgccgtcgccatcagcatgaacagcatcaccagcgatgatgcgattaacgccgccgaaaaaggcgcggcgttaacgctctccggcagcacgtccggcgtcgaagcggggcaaaccgtcaccgtcacctttggcggcaaaacctacaccaccacggtggcggcaaacggtagctggagcaccaccgttccggcggcggatttggcggccctgcgtgatggcgatgccagcgcccaggtgcgggtgactaacgtcaacggcaacagcgccacagcaacgcacgaatacagcgtcgatagcgccgcgccaacggtgaccatcaacaccattgccagcgataacatcatcaacgccagcgaagcggcggcgggcgtaacggtgtccggcaccagcaccgcgcaaaccgggcagacgctcaccgtcacgcttaacggcactaactaccagaccacggtgcagacagacggcagctggagtttaacgctgcccgccagcgacttaaccgcacttgctaataacggctacaccctgaccgccacggtcagcgatctggcgggtaaccttggcagcgccagcaaaggcgtgaccgtcgataccactgcgccggtgatcagttttaacaccgtggcgggcgatgatgtgattaacaacgtcgaacacattcaggcgcagattatcagcggcaccgccacgggcgcggtggcgggcgaccgcctggtggtgaccatcgccgggcagcagtatgtcaccagcaccgatgccagcggcaactggagcgtcggcgtgcctgccagcgtgatttccggccttgcggatggcacggtgaccatcagcgccaccattaccgatagcgcaggcaacagcagcacgcagacgcacaacgtacaggtgaacacggcggcagtgtcgctctcggtcagcactatcagcggcgataaccttattaacgccgccgaagcgggcagtgcgctgaccctgagcggcactggcactaatttcgcgacaggtacagtggtgaccgtgttgcttaacggcaaaggctacagcgccaccattcagagcaacgggagctggagcgtgaacgtgcctgcggcggatgttgcggcactcagtgatggcaccagctacacggttagcgcctccgctcaggacagtgccggaaacggcaacagcagcacgcagacgcacaacgtacaggtgaacacggcggcagtgtcgctctcggtcagcactatcagcggcgataaccttattaacgccgccgaagcgggcagtgcgctgaccctgagcggcactggcactaatttcgcgacaggtacagtggtgaccgtgttgcttaacggcaaaggctacagcgccaccattcagagcaacgggagctggagcgtgaacgtgcctgcggcggatgttgcggcactcagtgatggcaccagctacacggttagcgcctccgctcaggacagtgccggaaacagcgccacggcctcgcgcagcgtggcggtggatctcaccgcgccggttatcagcattaacaccgtttcgacggacgaccgcctcaacgccgccgaacagcagcagccgttaacccttaacggctcgaccagcgcggaagtggggcagacggtcaccgtcacctttggcggcaaaacctataccgccacggttgccgccaatggtacctgggcgctgaacgtgcctgcggtggatctggccgcgctcgggcagggcgcgcagaccattaccgccagcgtgaacgatcgcgccggtaaccccggacaggccacgcacgccctgaccgtcgataccgttgcgccaacggtcaccatcgccacggtggcgggtgacgatattatcaacaacgccgagcagcttgccgggcagaccattagcggcaccaccaccgccgaagtgggccagacggtgaccgttacctttaacgggcaaacctggagcgcaacggttggcagcggcggaagctggtcggtgtttattccggcgcagcagtttgccggattaagcgacggcagctacaccattagcgcgacggttagcgatcaggccggaaaccccggcagcgccagccgtggcgtgacgctgaacggcgatgtacctactgtcaccatcaacacctttgcgggcgacgatgtggtgaatgcagcggaacacggctcatcgctggtgatcagcggcaccaccaccgcgcccgtcgggcagacgctgaccctgaccttaaacggcaaaacctacaccaccacggtgcagacgggcggtagctggagctacaccctcggcagcgccgatgtcaccgcgctggcggacggcaacgcctacgtgattaacgcctcggtgagcaatgccattggcaacaccggtagcagtaatcacaccattaccgtcgatctcagcgctccggcgatgggcattaatatcgattccctgcaagccgacactggccttagcgccagcgactttatcaccagcgtcagtccggtagtggtcaacggctcgctcaccgccgcgcttgccagtaacgagacggcgcaaataagtatcgacggcggcacaacctggaccacgcttaccgttaccggcacgacctggcgctataacgacagccgcacgctgaccgatggcaactatctctatcaggtgcgggtgattgacgcagcgggcaacgttggcgcgaccgacagccagaatgtggtgatcgacactaccgcgccagatcccgcggtgaaaaccatcgccatcagcgcgatcaccaccgatatgggcttgatcactaacgattttgtcaccagcgacacgacgcttgcggtgagcggcacgctgggggcgacgctttctgccggtgagttcgcgcaaatcagcctcgacggcggcgtcacctggactacgttaaccgtcgttggcaccagctggagctatgccgatggtcacacgcttactgacggcacctggaactacacggtgcgggtggtggatctggcggggaacgttgggcagaccgcaacgcaaaacgtggtggtcgacaccaccagcccggaagcggcgaaaagtatcaccattaccggtatcagcgatgacaccggaaccagcagcagcgattttattaccagcgacaccacgcttaccgtgcgcggcgtattgggcgcggcgctcggcgctaatgagttcgcgcaaatcagtaccgacaacggcgcaacctgggtgaacgtgaccgtcgccgcagacagcctgaactggagttacgttgacggacgaaccctcaccaacggcaccaccacctggcaggtgcgggtggtcgatctggcgggcaacgttggcgcaacgagcagccagtcggcgctgatcgataccgttaacccggcgcaggtgctcaccatcgccagcatcagcaccgacacggggagttcggcaactgactttatcaccagcgacaccatgctcacgctgaccggttcgctgggggcggggcttgccagcggcgaagtggcgcagattagccttgatagcggcgcgacctggacaacgctcaccaccaacggtacacagtggacttacaccgacagccgcacgctgaccgacggcagctacgtttatcaggtgcgggtgctggatctggcggggaacaccggcccggtggtgtcgaaaacggtggtggtcgatacgattaaccccaccgccacaccaacgattgtgtcgtataccgatgatgtcgggcagcggcaggggacattaagcagttcgcaggccaccgacgacactacgccgctgctgaacggtgtactttccgcgccgcttgccagcggtgaagtggtttacctctaccgtaacgggctgctgttaggggcggtgacgatggtcggcgctctgaactggacctacagcgacagcgggctggtgagcggtgcctatacctacagcgcgcgagtggtggatttggcggggaatatcacctcctccagtgattttgtcctgacggtcgatacctctattccgaccacgctggcgcaaatcaccagccagaccacgcgcgatactacgccgattattagcggggtgatcaccgccgcgcttgccagtgggcagtatgttgaagtggtgatcaacggcaaaacctacacctctgaaccgggcggcgcggtagtggtcgatccggcgcacaacacctggtatgtacagttgccggataccgatgcgctgacagtttccgcgaccgcctataccgttactgcgcaggtaaaaagttcggcgggtaacggcaataacgccaatattagcaacggcacggtgacggttaacgcggcgattgattacacaccgacctggactaccgccagcaaaaccaccgcctgggggctgacctacggcctcgactcgcacgggatgtggacggtgctggcaaaccagcaggtaatgcaatcgactgacccactcacctggtcgaagaccgcgctgacgctgtatcagagcggcaacaactacgccaccagctccattgccgattacgaccgtaacggcacgggcgatctgtttatcacccgtgatgactacggtacgggctatattaacggctttaccaataacggcgatggcaccttttccagcgctattcaggtcaccgtcggcaccctgacgtggtacggctcgattgtggcatttgataaagagggcgacggctatctcgacttctggattggtgacgctggcgggccggactccaacaccttcctgtggaacaacgcaggcacgctggtaggcaactccaccacgtcgaacagcggcggtagcgccacggtgggcggggcggtgacggggtatctttcgctcaacgaaggttctggcgtcgatctgaacaatgacggcaggatcgacctggttcagcacacctataacctgaacaactattacacgctgtcttcgctcatcaaccaggggaatgggacgtttgtctgggggcagaacaccaccaataccttcctgagcggggcgggcagtggcgctatgagcagcagcgtttccatgacctgggccgatttcgatggtgacggcgatatggatctcttcctgcccgccagccagggaagagctaactacggctcgctgttattcaacaccaacggcgtactgggttgcccggtggcggtgggcgcaacggcaaccacctacgccagccagtttagcctggcggtggactggaaccacgacggcctgatggatatcgcccgtatcgcccagaccgggcagtcgtatctttatactaacgtcagcaacgccagcaactggacgcaatcggccctcggcggcagccagagcggtaccaccagcggcgtggcggcaatggactacgactgggacggcgcggtggatgtgctggtgtccaaacagtcgggcagcgtgttcctgagccgcaacaccaacacggtgagctacggcacttcgctacacctgcgcatcaccgatcccaacggcattaacgtctattacggcaataccgtgaagctgtacaactcggcgggagtgctggtcgccacgcaaatcatcaacccgcagtcgggtatgggggttaacgacacctcggcgctggtcaacttctacgggctgaatgccggagaaacctacaacgcggtgctgatcaaatccaccggcaccaccgccagcaatatcgaccagacggtcaacaccagctggggcggtttacaggccaccgatgccactcacgcttacgatctcagcgctgaagcgggtaccgcgagcaacaacggcaagttcgtcggcaccggctataacgacaccttcttcgccaccgcaggcaccgacacttacgacggttccggcggctgggtgtacagctccggcaccggaacgtggctggcgaacggcgggatggacgtggttgatttccggctttcgacggtgggcgtgacggctaacttaagcagcactgccgcgcaggccaccggttttaacacctcgacatttaccaatatcgaaggcatttccggctcgaattttaacgacattctgaccggcagcagcggcgataaccaactggaagggcgcggcggcaacgacacgctcaacatcggcaacggcggccacgacaccttgctctataaactgctcaacgccagcgacgccactggcggcaacggctcagacgtggtgaatggctttacggtagggacatgggaaggcaccgccgacaccgatcgcattgatattcgtgaactgttacagggcagcggctacaccggcaacggcaaagccagctacgtcaacggcgtggcaacgctggatgcgcaggccggaaacatcggtgactttgtcaaagtcacccagagcggcagcgacaccatcgtgcagatcgaccgcgacggcacgggcggcacttttgcgacaactaacgtggtcacgctgacgggcgtgcacaccgacctcgccaccttgctggcgaatcatcagttgatggtggtgtag

SEQ ID NO: 661 - DNA, 4038 bp, Escherichia coli 0157:H7
ttgggtgttcatacagccgaagccacactgcctaacggcaacaacgatacgaagatagtcaatattgcgcccgatgccagcaacgcgcaggttacgctgaacatccctgctcaacaggtggtgacgaataacagcgacagcgtgcagctgacggcgacggtgaaagatccgtcgaatcatccggtggcgggaataacggtgaacttcaccatgccacaggacgtggcggcaaactttaccctcgaaaataacggtattgccatcacccaggccaatggggaagcgcatgtcacgctcaaaggtaaaaaagcgggtacgcatacggttaccgcaacgctgagtaataacaataccagtgattcacagccggtaacgtttgtggcggacaaaacctcggctctggttgttcttcagatatcaaaaaatgagatcacaggtaatggcgtcgatagcgcaacgctaactgcaacggtcaaagatcagttcgacaatgaggtgaacaatcttccggtaacattcagcacagcttcttcaggcctcaccctgaccccaggggaaagtaataccaatgagtctggcatcgcgcaggccactctcgcaggcgttgcctttggtgagcagacggtcactgcatcactggctaataatggtgccagcgacaacaaaactgtgcattttattggcgacacagcggcggcaaaaattatcgagttgacgcctgtcccagacagcataatcgcaggtaccccgcagaacagctccggcagcgtcatcaccgccacagtcgttgataataatggctttccggtgaaaggtgtgactgtgaacttcaccagcaacgcagcgacagccgaaatgacgaatggcggtcaagccgtgacgaacgaacagggtaaggctaccgtcacttataccaatacccgctcctcgatagaatcaggagcgagaccggataccgttgaggccagtctggaaaatggtagctccacgcttagcacatcaattaatgtcaacgctgatgcgtctacggcacatctcaccttgctacaggcactttttgatacagtctccgcaggcgacactaccaatctgtatattgaggtgaaggataattacggcaacggagtaccccagcaggaggtaaccctcagcgtttcaccaagtgaaggtgtgacccccagtaataacgctatatatacgaccaatcacgacggcaatttttacgcaagctttaccgctacaaaagccggggtataccaagtgacggcaaccctcgaaaatggcgattcgatgcaacaaacagtgacctatgtgccgaacgtagcgaatgctgaaatctcgctggcagcctcgaaggatccggtaattgccaacaataacgatctcacgacactaacagcaacagtcgctgatacagagggcaatgcgatagccaacagtgaggtaacatttactctgccggaagatgtgagggcgaacttcacgctgggcgatggcggtaaagtggttactgatactgaaggcaaagcgaaagtcacgctgaaaggtacaaaagcaggcgctcatactgttacagcatcgatggctggcggtaagagtgagcagttggtggtgaactttattgcggatacactcactgcgcaggttaatcttaacgttaccgaggacaattttatcgctaataacgtcgggatgaccaggctgcaggcaacagtgactgatggaaacggcaacccgttagccaatgaggcggtgacattcacgctaccggcagatgtgagcgcaagctttactctcggacaaggcggttccgccattactgacatcaacggcaaggctgaagttacactgagcggtacaaaatccggcacctaccccgtgacagttagcgtgaacaattatggtgtcagtgatacgaaacaggtgactttgattgccgatgctggtaccgcaaaactagcctccttaacctctgtatactcattcgtcgtcagcacgaccgagggcgcgaccatgactgcaagcgtcactgacgctaacggcaacccggtagaaggtataaaagttaatttccgcggaacttccgtcacgctaagcagcaccagcgttgaaacggatgatcggggtttcgctgaaattcttgtgacaagcaccgaggtcggactgaaaacagtttcagcctctctggcagataaacctactgaagtcatctcgcgattactgaatgcaaaagcagatattaattctgcaacgattaccagtctggagatacctgaaggtcaggtcatggtcgcacaagacgtagcagttaaagctcacgtcaacgaccagtttggcaatccgattcttaatgaatctgtaacattcagtgcagaaccaccagagcacatgaccatcagccaaaatattgtctctactgatacgcatggtatagccgaggtcactatgacgcccgaaagaaacggttcgtatatggtgaaagcatccctggcgaatggatcctcttatgagaaggatctggtggtaatcgatcaaaaactgacactctcggcgtccagcccgcttatcggtgtcaattccccaacaggtgcaactctgacggcaacgctaacttctgcaaatggcactccagtggagggtcaggtcatcaactttagcgtaacgccagaaggtgcgacgttaagtggcggaaaagtgagaaccaactcttcaggtcaggctccagtcgttctgaccagcaataaagtcggtacatatacggtgactgcatcgttccataacggcgtaacaatacagacacagacaatcgtgaaagtcactggcaactcaagcaccgcccatgttgctagctttatcgctgatccatcgactatagccgccaccaacagtgatttaagtaccttaaaggcaacggttgaggatggcagtggtaacctgatcgaaggtctcactgtgtacttcgccttaaaaagcggctctgccacattaacgtcattaacagcggtgacagatcaaaacggaatcgcgacaacaagcgtgagaggagcgataacggggagcgtcacggtaagcgcagtcacgaccgctggtggaatgcaaacagtagatataacgctggtggcaggcccggcagacgcctcgcagtccgtccttaagaacaatcggtcatcattgaaaggagactttaccgatagtgctgagctacatcttgttctgcacgatatatcaggcaatccgatcaaagtttctgaagggctggaatttgtgcagtcaggtaccaacgcgccctatgtgcaagttagtgcaattgactacagtaaaaatttctcaggcgagtacaaagccactgttacaggcggcggagagggtatcgcaacgctgatccctgtattgaatggtgttcatcaagcgggtctgagtaccacaatacaattcactcgcgcagaagacaaaataatgagcggtacagtgttagtcaatggtgctaacctaccgacaactacattcccttcgcaggggttcactggggcgtattatcagttgaataatgacaactttgccccaggaaaaacggcggctgattatgagttttcaagctctgcctcctgggttgatgttgatgctaccggtaaagtgacatttaaaaatgtcggcagcaaatgggagaggattacggcgacgccaaaaacaggcggccctagctatatatacgaaatccgagtgaagagttggtgggtgaacgccggcgatgctttcatgatatacagccttgctgaaaatttttgcagtagcaatggctacacacttccccttggagaccatttaaaccatagtcgttcccgaggcatcgggtcactgtacagtgaatggggagatatggggcattacacgactgaagctggttttcattcaaatatgtattggtcatcgagtcccgcaaactcaaacgaacaatacgtagtttccctggcaacaggtgatcaaagcgtatttgaaaagcttgggtttgcttatgcgacatgttataaaaacctctga

SEQ ID NO: 662 - DNA, 4386 bp, Escherichia coli 0157:H7
atgagcctgattattgatgttatttcgcgtaaaacatccgtcaaacaaacgctgattaatcctggcgacgtcacggttgttatttatgagccttccgtggtgcaggttcatgctcaggcctctgccgttgcgcgttacgtccgtgaaggaaatgacctgctgatctatatgcaggacggcacggtgatccgctgcaacggttatttcctgcaagcggcgaatacagctgaacaatcggaactggtgtttgccgatggtcaacagctaacccatatcacctttgccgatactgctgcgggtggattagcccccgtagaactgactgcccagaccactgcgattgaaagcattgcgccatttcttgataccgttgctcagaccagcgccttcccgtggggttggctggcgggggcggcggtaggtggtggcgcgcttggtgcactgctggcaagcggtggcgatggcgactcgaaaacagaagtgattaataaccctacgccacctgctgagcctggcaacgccacaccatcatttttagttaccgataatcagggcgatcagcgcggcattctagccaccaatgacatcaccgatgacaccacgccaacctttagcggcagcgggcaggcgggggcgactattcagattaaagacagtaacggcaatactattgccagtactcaggtagacaacaacggtcactggagtgtctcgttacccacgcaaagtgcaggtgaacatacctggtcagtggtgcaaattgtcggcagtaccatcactgacgccggttcgataacgttaaccatcgacaatagtcaggccagcgtgcaggttgccaccaccgcaggcgataacattattaacgccagcgaacaggccgccgggtttacgctttctggcaccagtagccatctggcgcagggaacagaactcaccgttacgctaaacggcaaaacctacacgaccagcgtaggcgctaacggtgcctggagcgtgcaggtgccgaccgccgatgcacaggcgttaggcgaagggaatcaggcggtgctggtcagtgggaaagacgccacaggcaatacggtcaccggcgcgcagctactaacggtcgatacccaaccgccaacgcttgccatcaacaccatcgctcaggacaacattatcagtgctgcggaacataacgtcgcgctggtactgagcggcacgtcgaatgcagaagcggggcaaaccgtaacactgaccgtcaacgggaaaagccatacagcaaccgtcggtagcgacggaacctggcaagtgacgctgcctgccacggaagtccaggcactggcggagggtaattacgctgtcaatgccagtgtcagcgatcgggcagggaacaccaccagccacagcgcgaatttcacggtagacacctcagcacccgtggtcagtgttaataccgtggcgggcgacgatattcttaataatgccgagcaggccgtcgcgcagatcatctccggacaagtcagcggtgcttctccaggcgatacggtaacggtgaaattgggcactcatgtcctgacgggcatcgtgctggcagatggcagctggaatgtggcgctggacccagcggtaacccgcacgctggatcgcggagccaatacgattttcgtcaccgtgacagatgctgcaggaaatactggcgcggcgtctcgagcaatcacgctggtcggtgtttctccgttgatcaccattaacaccgtctccggcgatgacattatcagtggcgcagaaaaaggtgcgccactgacccttaccggtagcactcaacaggctgagacaggacaaaccgtcacagtaaccctggctggacagagttttaccactaccgtgcaggccgatggctcctggagtctgacggtacctgccgccgcgatgggaaatctgcctgacggcgcggtggcgattaccgcttctgtgacggatctcagcggcaataccggcaacacttcccgcaccattaccgtcgatagccaggccccggccttaagcattgatccactgaccgctgataacatcattaacgccgccgaaagcgggcaggatctgcccatcaccggcaccaccgacgctcagccggggcagacggtgaccgttacgttaaatgggcagacgtatcagggcgtcgtgcagccagacggcacctggagcgtgactgtgcccgccgccaacgtgggcgcactggctgacggcaacgctacggtcaccgccagcgtgaacgatgtcgccggtaatccgagcagcgtttcacgcgtggcgctggtggatgccacgccgccggtggtaaccattaatccggtggcgaccgataacgtcatcaacacgccggaacatgctcaggcgcaaatcatcagcggcacggttactggcgctcaggcgggcgatatcgtcaccgtgacgctgaataatgtggattacaccacggtggtggatggttccggcaactggagtctgggcgttccggcctcggtggtcagtgggctggcggacggcagttatcctgtcagcgtctcggtaaccgacaaagccggaaacacgggcagccagtcattgaccgtcacggtcaataccgccgcgccccttatcggcattaacagcattgcgggcgatgatgtgattaacgccagcgaaaaaggggccgatctccagattaccggcaccagcgatcagcctgttaacaccgccatcaccgtgacgctgaacgggcaaaattacaccaccacgaccgacgcctccggcaactggagcgtcaccgttccggcatcggcggttacagcattaggccaggccaactatacggtaacggcggcggtgaccagcgatatcggcaacagcgccactgccagccataacgtgctggtcgacagcgcgctgcccggtgtgaccattaatccggtggcaaccgacgatattattaacgccgccgaagcgggcgtggcgcaaaccatcagcgggcaggtgactggcgcggaagatggcgacacggtaactattacgttgggtggtaatacttatacggcgacggtgggcagcaatctcacctggagcgtggacgttccagcggcagatattcaggcgctgggaaatggcgatttaacggttaatgcctcagtcaccaatcaaaacggcaacaccggcagcggcacgcgggatatcaccatcgacgccaatctgcccggcctgcgggtcgatacggtggcgggcgatgatgtggtcaatatcatcgagcacgggcaggcgctggtggtcaccggcagcagctcggggctggctgaaagcacgccgcttaccgttacgattaataatgtggaatacaccactgcggtgcaggccgatggtagctggagcgtgggcgtcacggcggcgcaggttagcgcctggcctgcggggacggttaatattgccgtttcaggggaaagtagcgccggaaactcggtgagcattacgcatccggtgacggtggatctcactccggcagcgatcaccatcaacaccatcgccacggacgatgtgattaacgccgcagaaaaaggcgctgatttaaccctttccggcaccaccactaacgtagaacccggtcaaaccgtcaccgtcacctttggcgggaaaaattacactgccagcgtagcgagcgatggtagctggactgccaccgtacccgccgccgatctggcgtcattacccgagggcagcgcctccgcactggccagcgtcagcaatatcaacggcaatagcgcctcggcggtgcacaactacagcgtcgacagcagcgcgccaaccatcattatcaataccgtcgccagcgacaatatcgtcaacgccagcgaagccgatgcgggcgtgacggtgagcggcagtaccaccgccgaagcggggcagattgttacgataacgcttaacagcccgaccgtgcagacctatcaggcaacggtgcaggcggacggcagctggagcatcaatattccggcggcagatcttgaggcattgaccgatggcagccacaccctgaccgccacggtcaatgacaaagcgggcaatccggcgagcaccacgcataatctggcggtggatctcaccgttccggtgctgaccatcaacaccattgcgggcgatgacattattaacgccaccgaacacgggcaggcgctggtgatttccggttccagcaccggcggagaagcgggggatgtcgtcaccgtcacgctaaacagtaaaacctacaccaccaccctggacgcctccggcaactggagcgtcggcgttccggcggcggatgtcacggcgcttggcagcggcccgcaaactgtcaccgccacggttaccgatgcggcaggcaacagcgacaattag

SEQ ID NO: 663 - DNA, 4032 bp, Escherichia coli 0157:H7
atgaatagaatctatcgcgtgatatggaattgcactctacaggtatttcaggcctgctcggaattaactcgcagggtaggtaaaacatcaacggttaatttgcgaaagtcctctggactgacaacgaaattcagtagattgacgctgggtgttttgctggcactaagcggttcagtgtctggtgcgagtctggaagttgataatggtcagattaccaatattgatactgatgttgcttatgatgcctacctggttggctggtatggcactggagtgcttaatattttggctggcggtaatgcctccttaaccactattactaccagcgtcattggcggtaatgaggattcggagggtaccgttaatgttttgggtggcacctggcgattgtatgatagcggaaataatgcaaggcctttaaatgtgggtcaatccggaacggggacgctgaatattaaacagaagggtcacgtcgatggaggctatttaagattaggtactcaagctgcaggcgtcgggacggttaatgttgagggagaggactcggttttgacgaccgaattattcgaaatagggagttacggtacgggctcattaaatattacggataagggttacgtcacgagttcaatagtcgccattttaggatatcaagcgaacagtaatggtaaggttgtcgttgaaaagggtggcgagtggctaataaaaaataatgattcctcaattgaatttcaaattggtaatcaaggaactggggaggcgactattcgcgagggtgggctgattacggctgaaaatacgattatcggtggcaatgccaccggtgtcggaaccctgaatgtgcaggatcaagactctgtcatcacggtacgcagactctataatggatatttcggtaatggcgcagtcaatatttccaataatggactaattaataacaaagaatattcattggtgggcgttcaggacggttcccacggtgtcgtcaacgtgaccgataaagggcattggaatttcctcggaacgggcgaagctttccgctatatctatatcggtgatgctggcgacggtgaacttaatgtctcgcgtgaaggtaaagtagattcgggaattatcactgcggggatgaaagaaacaggcacaggcaaccttactgttaaggataagaactccgttatcactaatctcggaactaatcttggttatgacggccacggcgaaatgaatatcagtaatgaggggcttgttgtcagcaacggaggaagctctctcggttatggagaaaccggcgtcgggaaggttagcatcaccacgggggggatatgggaggtcaataagaatgtctataccaccattggtgttgcgggcgtcggaaacctcaatattagcgatggcggtaagttcgtatcgcaaaatattacttttttgggcgataaagcaagcggtatcggcacactgaacctgatggatgcgacatcgtcgttcgatactgtgggtatcaatgtcggtaattttggtagcggtatcgtaaatgtcagtaatggtgccacccttaattcaacgggctatggatttatcggaggaaatgcctccggtaagggaatagttaatatttcaacggatagtctctggaatttaaagacgtcttctactaacgcccaattgctacaggtcggtgtattaggcacgggtgaactgaatattaccaccggaggtatagttaaagcgcgtgatacacagatagctctcaatgacaaaagtaagggcgacgtgagggtggatgggcagaactctcttcttgaaacattcaatatgtacgtagggacatctggtacgggtacgttaaccctgacgaatagcggcacgctgaatgtcgaaggtggagaagtttacttaggtgtttttgaacctgctgtaggaacgctaaacattggtgcagctcacggtgaggcggcggcagatgccggatttatcaccaacgcgacgaaagtagagtttggctctggcgaaggtgtttttgtctttaatcatactaataacagtgatgccggctaccaggtcgatatgctgattacaggtgacgataaagacggaaaagtgatccatgatgcaggccatacggtgttcaatgcagggaatacttatagcggtaaaacgctggtcaatgacggcctcctgaccattgcgtctcatacggcagatggggtaacgggcatggggtcgagtgaagtaaccattgcaagccccggtacgctcgacattctcgcatcaacgaacagtgcaggagattacacgctgaccaatgcgctcaaaggcgatggcttgatgcgagttcagctgtcatcctccgacaagatgtttggctttacacatgcaacagggactgaattcgccggtgttgcccaactgaaagacagtaccttcactctggaacgcgacaacaccgctgcgcttactcacgcgatgttgcagtctgacattgaaaataccacatcggtaaacgtgggagagcaatccattggtggactggccatgaatggcggtacgctcattttcgatacggatattcctgctgcgacgcttgcagagggatatatcagcgtcgatacgctggttgtcggcgcgagtgactacacctggaaaggccgtaactatcaggtaaacgggacgggcgacgtgcttatcggcgtgcctaaaccgtggaatgatcctatggcgaataaccctctgacgacgctcaatttgctggaacacgatgataaccatgtcggcgttcaactggtgaaggcgcaaacggttattgggtcgggtggctcattaacgttacgtgatttacagggcgacgaggtggaagcggacaaaacgttacacattgcgcaaaacggaacggtggtcgccgagggtgattatggattccgcctcacgaccgcaccaggtgatggtttgtacgttaactatgggctgaaagcgctgaacatccatggagggcaaaagctgacgttagccgaacatggcggagcctatggcgcaacggccgatatgtcggcaaaaatcggtggtgaaggggatctggcaatcaatacggtgcgacaggtttcgctttccaacggtcagaacgactatcagggggcaacctacgttcagatggggacattacgtaccgatgcggatggcgcgctgggcaacacccgggaactgaacatcagcaacgcagccatcgtcgatcttaatggatcgacgcagacggtagagacattcaccgggcagatgggttcgactgttttgttcaaagaagggtcgctgacggtaaataaaggtgggatcagtcagggtgaactgacaggtggcggaaacctgaatgttacagggggaacgctggctgtcgaggggcttaatgcacgctacaatgcgttaaccagcgttagcccaaatgcggaagtcagcctcgataatacgcaggggttaggcagaggaaatattgccaatgacggtctgttaacgctaaaaaacgtgactggcgaactgcgtaatagcataagcgggaagggtatcgtgagcgcaaccgccaggacagatgtagagctggatggcgataatagccgctttgtggggcaattcaacattgatacaggcagcgcgctcagcgtcaacgagcagaaaaacctgggtgatgcttccgttatcaataatggcctgctcaccatctccactgagcgtagctgggcgatgacgcacagtatcagcggtagcggtgatttgacaaaactgggtaccgggatcctgactcttaacaacgattcctcggcgtatcagggtacgacggatatcgtggggggggaaattgctttcggttccgactctgccattaatacggcaagtcaacacattaatatccataacagcggtgtgatgtcgggaaatgtcaccactgcaggtgatgtgaacgttatgtctggggggacactgcgtgtcgctaaaaccacaatcggcgaatcggcggcaacctggagaatggcggcacggttcaaatga

SEQ ID NO: 664 - DNA, 1644 bp, Escherichia coli 0157:H7
atgggcatcaaacaacacaatgggaataccaaagccgatcgtctcgctgaattaaaaatccgttcgccctcaattcaactgataaaatttggcgctattggtttgaatgcaattctcttttcccccctgctgatagctgctgatacaggaagtcaatatggcaccaatattactattaatgatggtgacagaattactggagataccgccgatccatcaggaaacctctatggtgtaatgaccccagcaggaaacacgcctggcaatatcaacctgggtaatgatgtcaccgtcaatgtcaacgacgcctctggatatgcaaaaggaatcattattcagggcaaaaacagctccctgacagctaaccgactcacagtagatgttgttggtcaaacctctgccatcggcattaatttaattggtgactatacccatgctgacttaggcacaggcagcaccattaagagtaacgatgacggcatcattattgggcatagctcaacactaacagccactcaattcaccattgaaaactcgaacggtataggcctaaccatcaatgactatggcaccagtgtcgatcttggaagcggaagtaaaatcaagaccgatggaagtacaggtgtttatatcggtggtctcaacggcaataacgccaatggtgctgcgcgttttacggcgacagacctgacaatcgatgttcagggctacagcgccatggggataaacgtacagaaaaactctgttgtcgatctcggaacaaacagttccattaaaaccagtggcgataatgcacacggcctctggagctttggccaggttagcgcgaatgcactcactgttgatgtaactggagccgcggccaatggcgtcgaagttcgtggtggtacaaccactatcggtgcagatagccatatttcttccgcgcagggcggtggtctcgtcaccagtggttcagacgcgacaatcaatttttctggcacggcagcgcaacgaaacagcatcttttccggcggttcttatggtgcctcggcccagacggcaacggctgttatcaacatgcaaaataccgatattacggttgatcgtaatggcagtctggcgctgggtttgtgggcgctcagcggcggtagaataaccggagacagtttggctatcaccggcgcggcaggagccagggggatttatgccatgaccaacagccagatcgacctcacgagcgatctggtcattgatatgagtacacccgaccagatggccatcgcaacgcaacatgacgatggttatgccgccagccgcatcaacgcctcgggtcgtatgcttatcaacggtagcgttctttccaaaggtgggctaatcaatctggatatgcaccctgggtcggtttggacaggttcctccctcagcgataatgtcaatggcgggaaactggacgttgcaatgaataacagcgtctggaacgtaacaagtaattctaatctcgacacgctggcgctgagccattcaactgtcgattttgccagccacgggtcaactgccggcacatttaccacattaaacgtagagaacctgagcggtaacagtacctttattatgcgtgctgatgttgttggcgagggtaatggcgttaagccctgggcctga

SEQ ID NO: 665 - DNA, 705 bp, Escherichia coli 0157:H7
gtggggatcgacagccgtaatgatattcctgaggggattgcgacgctgggcgcttttatgggttattcccattcacatatcggttttgatcgtggaggacatggcagtgtggacagttattctctgggcggctatgccagttgggaacatgaaagtggtttctatctggacggtgtcgtgaagctgaaccgttttgaaagtaacgtagccggtaaaatgagcagcggtggagccgccaatggcagttaccatagcaacgggctgggcggtcacattgaaaccgggatgcgatttaccgatggtaactggaacctgacgccgtatgcctcgttaacggggttcaccgctgataaccccgaatatcatttatccaatggcatggaatcgaaatcagtcgatacccgcagtatatatcgtgaactgggtgcaacgctgagttacaacatgcgtctggggaacggtatggaagttgagccgtggctgaaggcggctgtgcgcaaagaatttgtcgatgataaccgggtgaaagtgaatagtgacggtaatttcgtcaatgatttgtcgggcagacgtggaatataccaggcaggtattaaagcctcattcagcagtacgttaagcgggcatcttggggtggggtatagcaacggtgctggtatggaatccccgtggaacgcggtggctggtgtgaactggtcgttctga

SEQ ID NO: 666 - DNA, 588 bp, Escherichia coli 0157:H7
atgaaaaaaaaggttctggcaatagctctggtaacggtgtttaccggcatgggtgtggcgcaggctgctgacgtaacagctcaggctgtagcgacctggtcagcaacagccaaaaaagacaccaccagtaagctggttgtgacgccactcggtagcctggcgttccagtatgccgaaggcattaaaggttttaactcacagaaaggtctatttgacgtggctatcgagggtgactcaacggctaccgcctttaaactgacctcacgtcttatcaccaacacattaacccagttggatacctcaggttccacactgaatgtgggcgtggattataacggcgcggcagtcgaaaaaactggcgataccgtgatgatcgataccgccaacggcgtactgggcggcaaccttagcccgctggcaaacggttacaatgccagcaatcgtaccaccgcacaggatggtttcactttctccatcatcagcggcaccaccaatggtaccaccgcagtaaccgattacagcactctaccggaaggcatctggagcggcgacgttagcgtacagttcgacgcgacctggaccagttaa

SEQ ID NO: 667 - DNA, 606 bp, Escherichia coli 0157:H7
atgacggcagaatcctacgatgataactacctggatgatgaagacgcggactggaccgcgaccgggcaggggcagaaatctgcaggtgataccagttttacgctggcctggaaaccgggagaggaaggccagaaagggcttataggctggtttgaaagcggcgatgtccgggcctataaaatccgttttccgaatggcacggtggatgtgtttcgtggctgggtcagcagtatcggtaaggccgtgacggcgaaagaagtgatcacccgcacggtgaaagtcactaacgtgggtaaaccttctgtagcggaagaacgcagcaaaattacgccggtcagtgcgattaaggtgacgccgacatccggtacggtggcaaaagggaaaacaaccaccctgacggtttcttttgagccggaaagtgcaacagacaagacgttcagagcggtttccgccgatccgtcgaaagccaccattagtgtgaaagatatgacaattacggtaaacggcgtggcgacaggtaaggtgcagatccctgtggtgagcggaaatggtcagttcgccgcagtggctgaagtcaccgttactgaagcgggcgctgcagggtaa

SEQ ID NO: 668 - DNA, 606 bp, Escherichia coli 0157:H7; identical to SEQ ID NO: 667

SEQ ID NO: 669 - DNA, 2148 bp, Escherichia coli 0157:H7
atgttatataatataccttgtcgaatttatatcctttccactctgtcattatgcatttctgggatagtttctactgcaaccgcaacttcttcagaaacaaaaatcagcaacgaagagacgctcgtcgtgaccacgaatcgttcggcaagcaacctttgggaaagcccggcgactatacaggttattgaccaacaaacattgcagaactccaccaatgcctccatagccgataatttgcaggacatccccggagtagagataacagacaactccttggcaggccgtaaacaaatccgcattcgtggcgaagcatcctcccgtgttttaattctcattgatggtcaggaggtaacttatcagcgcgccggagataattatggtgtgggactgttgatagatgagtctgcgctggagcgtgttgaggtagtgaaaggtccatattccgtactgtacggttcacaggcaattggcggtattgttaacttcatcaccaaaaagggaggtgacaaacttgcatctggagttgtgaaagctgtttataattccgcaacagcaggctgggaagaatcaatcgcggtccaggggagcatcggtggatttgattatcgcatcaacggtagttattctgatcagggcaatcgtgatacgccggatggacgtctgccgaataccaactatcgtaacaatagtcagggtgtatggttgggttataactccggaaaccatcgttttggcctctcgcttgatcgctacagactcgcgacacaaacttactatgaggatccagacggaagttatgaggcatttagtgtcaaaatacctaaacttgaacgagagaaagttggggtattctatgacacagacgtggacggtgactatctaaaaaaaattcatttcgacgcgtatgagcagaccatccagcgccaatttgccaacgaagtaaaaacgacacagcctgttcccagtccgatgattcaggctctgaccgttcataacaagactgacacccatgataagcaatacactcaggcggtcacattgcagagtcacttttcgctgcctgctaataatgaacttgttaccggtgcacagtacaaacaagatagggtcagccaaaggtccggtggcatgacctcaagcaaatctctgaccggcttcattaataaggaaacacgaactcgctcctattatgagtcagagcaaagtacagtctcactattcgcacaaaatgactggcaattcgccgatcactggacatggacaatgggagttcgccaatactggctttcttcaaagttgacgcgtggtgacggagtatcatataccgcaggcattataagcgatacctctcttgccagagagtctgcgagtgatcacgaaatggtaacatctacaagcctgcgctattcaggtttcgataacctggagttacgcgctgcgttcgcgcaaggctacgtatttcccacactctcccagctttttatgcagacatctgcgggcggcagtgtcacatacggaaatcctgatcttaaggctgaacactccaataactttgaattaggtgcacgatataatggtaatcagtggctgattgacagcgcagtttactactcagaagctaaagattatattgcaagtctgatctgtgatggcagtatagtttgcaatggtaacaccaactcctcccgtagtagctactattattatgacaatattgatcgggcaaaaacatggggactggaaataagcgcggaatataatggctgggttttctcgccatatatcagtggcaatttaattcgtcggcaatatgaaacttcaacattaaaaacaactaatacaggtgaaccagcgataaacggacgtatagggctgaaacatactcttgtgatgggtcaggccaacataatctctgatgtttttattcgtgctgcctctagtgcaaaagatgacagtaacggtaccgaaacaaatgttccgggctgggccactctcaactttgcagtaaatacagaattcggtaacgaggatcagtaccggattaacctggcactcaataacctgacagacaaacgctaccgtacagcacatgaaactattcctgcagcaggttttaatgcagctataggttttgtatggaatttctga

SEQ ID NO: 670 - DNA, 642 bp, Escherichia coli 0157:H7
atgacaaaaatgagtcgctacgccttgattaccgcgctggcgatgtttctcgccgggtgtgtggggcaacgtgaacctgcaccggtagaagaagtgaaaccagcgccggaacaaccagccgagccacaacagcctgtccccacagtgccctcggtgccgacgatcccgcagcagccaggcccaattgagcacgaagatcaaactgcaccgcctgcgccgcatattcgccattatgactggaatggcgcaatgcagccgatggtcagtaagatgcttggggctgacggggtgactgcgggtagcgtcctgctggttgatagcgttaacaaccgtactaacggttcgctgaatgccgcagaagcgaccgaaacgctgcgaaatgcgctggctaataacgggaaatttaccctggtttccgcccagcagctgtcgatggctaagcaacagttaggtttgtcgccgcaggatagtttaggcacccgtagtaaagccataggcattgcccgcaatgtcggcgctcattacgtgctgtactccagcgcctctggcaacgttaacgctccgaccctacaaatgcagctgatgctggtgcagacgggcgaaattatctggtcaggtaaaggtgccgtttcgcagcaataa

SEQ ID NO: 671 - DNA, 372 bp, Escherichia coli 0157:H7
atgaaaagcaaagtactggcacttttaattcctgccctgctcggcgcaggtgctgcacatgcagccgaagtttataataaagacggcaacaaattagatctgtatggcaaagttgatggcctgcattatttttctgataattcagcgaaagatggcgaccagagctatgcgcgtctgggttttaaaggcgaaacccaaattaacgatcaacttactggctacggtcaatgggaatacaatattcaggcaaacaacactgaatcttcaaaaaaccagtcatggacccgtctggcatttgccggactgaaattttcagattacggttctttcgattacggacgtaattatgggctggaccgatatgctgcctga

SEQ ID NO: 672 - DNA, 753 bp, Escherichia coli 0157:H7
atggcaacaccaaatccccttgagccggtaaaaggtgccggtaccactctgtgggtttacaacggcaagggtgatgcttatgcaaacccgttgtcagacgatgactggcagcgactggctaaggtgaaggatctgacgccgggcgagatgacggcagaaccctacgatgataactacctggatgatgaagacgcggactggaccgcgaccgggcaggggcagaagtctgcaggagataccagttttacgctggcctggaaaccgggagaagaaggtcagaaagggcttataggctggtttgaaagcggggatgtgcgggcctataaaatccgtttcccaaatggcacggtggatgtgttccgtggctgggtcagcagtatcggtaaggccgtgacggcgaaagaagtgatcacccgcacggtgaaagtcactaacgtgggcaaaccttccgtggcggaagaacgcagcgaaattacgccggccactgcaattaaggtgacaccgacatccggtacggtggcaaaagggaaaacaaccaccctgactgtttcttttgagccggaaagtgcaaccgacaagacgttcagagcggtttccgccgatccgtcgaaagccaccattagtgtgaaagatatgacaattacggtaaacggcgtggcgacaggtaaggtgcagatccctgtggtgagcggaaatggtcagttcgccgcagtggctgaagtcaccgttactgaagcgggcgctgcagggtaa

SEQ ID NO: 673 - DNA, 753 bp, Escherichia coli 0157:H7
atggcaacaccaaatccccttgagccggtaaaaggtgccggtaccactctgtgggtttacaacggcaagggtgatgcttatgcaaacccgttgtcagacgatgactggcagcgactggctaaggtgaaggatctgacgccgggcgagatgacggcagaaccctacgatgataactacctggatgatgaagacgcggactggaccgcgaccgggcaggggcagaagtctgcaggagataccagttttacgctggcctggaaaccgggagaagaaggtcagaaagggcttataggctggtttgaaagcggggatgtgcgggcctataaaatccgtttcccaaatggcacggtggatgtgttccgtggctgggtcagcagtatcggtaaggccgtgacggcgaaagaagtgatcacccgcacggtgaaagtcactaacgtgggcaaaccttccgtggcggaagaacgcagcgaaattacgccggccactgcaattaaggtgacaccgacatccggtacggtggcaaaagggaaaacaaccaccctgacggtttcttttgagccggaaagtgcaaccgacaagacgttcagagcggtttccgccgatccgtcgaaagccaccattagtgtgaaagatatgacaattacggtaaacggcgtggcgacaggtaaggtgcagatccctgtggtgagcggaaatggtcagttcgccgcagtggctgaagtcaccgttactgaagcgggcgctgcagggtaa

SEQ ID NO: 674 - DNA, 768 bp, Escherichia coli 0157:H7
atgggctggaccgatatgctgcctgaatttggcggtgactcttataccaatgcagacaactttatgactggtcgtgccaatggcgtcgcgacttatcgtaatactgatttcttcggtctggtaaatggtctgaacttcgcggtgcagtatcaaggtaacaacgaaggtgccagtaatggtcaggaaggcaccaacaacggacgtgatgttcgccatgaaaacggtgacggctggggtctttccacaacatatgatttaggcatgggctttagcgctggtgcggcatacacctcttctgaccgcaccaatgaccaggttaaccatactgcggcgggtggtgataaagcagacgcgtggactgctgggctaaaatacgatgctaacaatatttacctggcaaccatgtattcagaaacgcgtaatatgaccccgtttggcgacagcgattatgctgttgcaaacaaaacccagaactttgaagtcactgcacagtaccagtttgattttggtctgcgtccggcagtctctttcctgatgtctaaaggccgtgacctgcacgctgccggtggtgcagacaacccggcaggtgttgatgataaagatctggttaaatacgccgatgttggcgcgacttactatttcaataaaaacatgtccacttatgttgactataaaatcaacctgttggatgaagatgacagtttctacgctgccaacggcatctctaccgatgatattgtcgctttaggtctggtttatcagttctaa

SEQ ID NO: 675 - DNA, 1140 bp, Haemophilus influenzae Rd
atggggtttattatgaaactaactaaaacagcattatgtactgcactttttgccacctttactttttcagcgaacgcacaaacttatcctgatttgccagtggggatcaaaggaggaacaggcgcattaattggcgacacagtttatgtgggattaggttctggtggcgataaattctataccttagacctaaaagatccttcagcacaatggaaagaaattgctacatttccgggtggcgaacgcaatcaacctgttgcagccgcagtggatggaaaactttatgtattcggtggtttacaaaaaaatgaaaaaggcgaacttcaactcgttaatgacgcttatcgctataacccaagcgataatacttggatgaaacttcctactcgttctccccgtggtttagtaggatcaagtggtgcatctcacggagataaagtttatattttaggcggctctaatctctctatatttaatggcttcttccaagacactgtggcagcaggtgaagataaagcgaaaaaagatgaaatcgcagcagcttatttcgatcaacgtccagaagattatttctttacaacagaattattgagctatgaaccatcaaccaataaatggcgcaatgaaggtcgtattccattctctggtcgtgctggtgcagcctttacaattcaaggtaatgagctagtggttgtcaatggcgaaattaaacctggacttcgcaccgctgaaacccatcaaggtaaattcactgctaaaggtgtgcaatggaaaaacttacctgacttacctgctccaaaaggcaaatcacaagatggtttagctggtgcgctttcaggctatagtaacggtcattatttagtcactggcggcgcaaattttccaggttcaatcaaacaattcaaagaaggaaaacttcacgcacataaaggtttaagcaaagcttggcataacgaagtttatacgttgaataatggtaaatggcgcattgttggggaattaccaatgaatattggttatggtttttctgtatcttacaacaataaagttttactgattggcggtgaaactgatggaggtaaggctttaactagcgtcaaagcaataagctatgacggtaaaaaattaaccatcgaataa

SEQ ID NO: 676 - DNA, 306 bp, Haemophilus influenzae Rd
atgggagaacaatatatgcttacgacgatactcagcttcctcattgtaaccactgtggttgcgtatgtttcttggttaaaaacaaaaggggatgatttaaaatcttcaaaagggtattttttggcagggcgtgggttaagcggtttagtaattggctgctcaatggtgctgacatcgctttcaactgaacaacttatcggtgtcaatgcggtgtcctataaaggtaatttttccgtgattgcttggacagttccaacggttattccgctttgtttcttggctctttatataattggctggctataa

SEQ ID NO: 677 - DNA, 2007 bp, Helicobacter pylori J99
atgaaaaatcaacacaaaaatcccctaacaaaagctttaatgaaaacttatccatataaccattttttatttttctgctttattctaggagcgtttttattaggtttgctcagtccagcttatgctttaagtattatcaccactaaagaaattgacgctaatttgcttaatggagcgatagaaagcagggtggtgttaggcaagagggtgtttaaagtagaagctcatgggttttattttagaaacaatgcgactaacagcatagatatagaaatcaccagtcttttaagagacaatcaatcgtttcctttgactagcagtgctaaaaccagtttaaaaatacctcctaacgccaagattaaaaaatccactatccttgttttgaaaggcgagaacgctgaagaagtggctaagattttaggcgttagcaaagaagaataccaaaagctagaaaacatcgctcaaaccaaagcggctaatgaccctatgtatgctaacacgccttttagtaatggttctgatagttccttttacgataacaatcctaatagccctagcaataacgctatcaatggcaaagatggcgcaaatgggagtaacggctatggggcaaatggcaatgatggggtaaatgggatcagtgggagtaatggtgcaaatgggagtcattcaaataataatgcaataggcagtggtattgatacagatggcgtgttaggggtggatggggtgaatggctctagttcttcaagtggcggctctgtagggggttatgagaataatttcactaatcatggctctactaacaataacacaggagggtatgacaattttaataatggcagctcaagtggtgggagtttagggaatggggggcttttccctattccttttggtaatggagacacaaacaattccaataattccactaacaccactagcccaactaatggcagtagttctaataacgccactaatcctagttcgcaagaaaacaattactccagccagtattgtaaagtgccagagttaagccccaacaacacgatgaaactagatgttatcgctaaagatggctcttgtatttctatgaacgctttaagagatgacactaaatgcgcttatagatacgattttgaagccggtaaagccatcaagcaaacgcaatactactatgtagatagggaaaataaaacgcaaaatatcggtggttgtgtggatttacaaggcgctcaatacgccatgcaactttacaaagatgacagcaaatgcgccttacaaaccacgagcgataaaggttatggtatggggaaaacgcaaacctttcaaactgaaatcgtgtttcgtgggatggacaatttaatccatgtcgctgtgccttgcagcgattatgcaagggtgcaagacaggattgttaggtatgaaaaaaatgataaaacccaaaccttaacgcctatagtggatcagtattataatgatcctaacaaccctaacaagcaagagattttaaatcgtgggattgccacccaattaagctcgcaatatcaagaatttgcatgcggtcaatgggaatacaatgacgctaaattagaagccaaaagacctacaatgctaaaaagctataacaagcttaatggagaatgggtagaagttacgccctgtaattttgaagcagggattaaaagcggtgcggttgttagcccttatgtgatgggcgtgcctagttctaaagtcttaagcgatattactacaagccattattttaggatagaaaggaaaaattatggtgagagagaacaatgccaaaaactttatggagtcaatcgttgccaaccgcaatattccatactgatcctagtatcaccgattggagcgccacttacaaaaccactaccacccaaaccactcaaccttatttacgcccagcccaagataatgaaaaacaccccacaacctataatcttatcaccactcaaaccaccatcaacaggactcaaagcgttttga

SEQ ID NO: 678 - DNA, 1152 bp, Helicobacter pylori J99
atgcctgttataagagttttagtaatgcttgcaacaatgatgatgaaattagtaaaaacggcaaaagaaaagaaagtttttaagaatgtgggaatatctataatggggattgctttttgggaagcgataaaagactcgataaaaaaacaaattaaaaaaagcgattggatatgcgggaatgttaagactgcggatgattatttaaaaacgcatcctaactcatggtttaattcagcaataggtgtaacagcgataacagccatgcttatgaatgtgtgttttgctgatgaccaatccaaaaaagaagtggctcaagctcaaaaggaagctgaaaacgctagggatagagcgaacaagagtgggatagaactggaacaagaagagcaaaagacagaacaagaaaaacaaaagacagaacaagaaaaacaaaagacagaacaagaaaaacaaaagacagaacaagaaaaacaaaagacagaacaagaaaaacaaaagacaagcaatatagagactaacaatcaaataaaagtagaacaagaacaacaaaagacagaacaggaaaaacaaaagacaaacaatacgcaaaaagatttggttaacaaagcagaacaaaattgccaagaaaatcataatcaattctttattaaaaaattaggaattaaggctggcattgctatagaaatagaagctgaatgcaaaacccctaaacccacaaaaaccaatcaaacccctatccagccaaaacacctcccaaactccaaacaaccccattctcaaagaggatcaaaagcgcaagagcttatcgcttatttgcaaaaagagctagaatctctgccctattcacaaaaagctatcgctaaacaagtggatttttataggccaagttctatcgcttatttagaactagatcctagagattttaacgctacagaagaatggcaaaaagaaaatttaaaaatacgctctaaagctcaagctaaaatgcttgaaatgaggagtttaaaaccagacccacaagcccacctttcaacctctcaaagccttttgctcgttcaaaaaatatttgctgatgttagtaaagaaataaaagtagttgctaataccgagaaaaaagtagaaaaagcgggttatggttatagtaaaaggatgtag

SEQ ID NO: 679 - DNA, 804 bp, Helicobacter pylori J99
atgaactaccctaatctacctaacagcgctttagagataagcgaacagccagaagtgaaagaaatcactaacgagcttttaaagcaattacaaaacgctttaaggagcaacgcgcattttagcgagcaagtggaattaagccttaaatgcatcgttaggattttagaagtgcttttgagtttggatttttttaagaatgcgaatgagattgatagcagtttaagaaattccattgagtggctgactaacgccggcgagagcttgaaattaaaaatgaaagaatacgagcgcttttttagcgagtttaatacgagcatgcatgccaacgagcaggaagtaaccaataccttaaacgctaacgccgagaacattaaaagcgaaattaaaaagctagaaaatcaattgatagaaaccacgacaagacttttaacgagctatcaaatctttttaaaccaagccagagataacgctaacaaccaaatcacaaaaaacaaaacccaaagccttgaagcgattacacaagctaaaaacaacgctaataatgaaataagcaacaatcaaacgcaagcgataactaatatcaccgaagcgaaaacgaacgctaataatgaaataagcaacaatcaaacgcaagcgataactaacattaacgaagccaaagaaagcgctacaacgcaaataaacgccaataagcaagaagcaataaataacatcacgcaagaaaaaacccaagccacaagcgagatcaccgaagcgaaaaagaccgatcattatcaaaacattgatttttttgagtttgaataa

SEQ ID NO: 680 - DNA, 636 bp, Helicobacter pylori J99
gtgaaatttttttcaaaggatttgtttaaaaaagtaactcctttatttttaagcgtttattttttaagccccacccttacgcaagccaaaagccgtttttatgtggcttctcaataccaggtggggaaaatgatcatgaaaaaatacaacgatctcaaacgcacgattgaaggggcgagcttttctttaggctgggagattaaccccactaattactggttttattcgcgctattacttttttatggattacgggaatgtcattctcaataaaagaacgggcgctcaagcgaacatgttcacttacggctttggaggggatttgatcatggaatacaataaaaaccctttgtatgtattttctcttttttatggcatgcaagttgctgaaaacacatggacgatttccaaacacagcgcgaatttcatcattgacgactggcgcagcattcaagggttttcgctcaaaacttcaaatttcaggatgttgggtttagtggggtttaaattccaaaccgtgctattccaccatgacgctagtattgaagtggggatcaaatggccttttgcttttgaatacgactcaccctttgtaaggcttttttctgtctttatttcgcacactttctacctttaa

SEQ ID NO: 681 - DNA, 522 bp, Helicobacter pylori J99
atgaaaaaatttaccctatcgctatttttgtgttgcaccttacttaacgctgaagaggatatttttaggaacaacacaaatgaaactgatcttacaaattcttttgaacatggcaaagaaaacaacaatcttatcccagcaaaatccgatagtttagaaagtttcaaagaacaagaaaacaaagaaaaagccaaacagcttatggatttaaaggccttacagagcgtgtatttttctaaaaatagaaaattgcaagacaataatttcaatgtcttgtatgtggcaggcaacaccaacaaaatccgcttacgctatgcgatgactaccacctttatttttgataatgatcctattatctatgtgagtttaggagatcctagcgattttgaactcacttaccccactaatgatcattacgatttgtctaacatgctagtgattaagccgttacttataggggtggatacgaacctaaccgtagtcggagcgagcggcacaatttataccttattatttgtttag

SEQ ID NO: 682 - DNA, 666 bp, Mycoplasma pneumoniae
gtgttggattatgtgccctggattgggaatgggtacaggtatgggaataaccaccgggggagcaacagtagtacgagtggggtaacgacccagggacaatcccaaaatgcatccagtaacgaacccgcaccgacgttttcgaatgtcggcgttggtctcaaagccaatgtcaacggcaccttaagtggttcgcgaactacgcctaatcagcaaggcactccctggttaaccctcgaccaagccaacctccagctctgaacgggcgcggggtgaaggaatgataagaacggacaaagtgacgaaaactacaccaatttcgcgagtgctaagggcagtacgaaccagcagggttcaacaacgggtggatcagcgggcaaccccgactcgttaaagcaggataaggctgataaaagtggtgattcggtaacggttgcagaagccacatcgggcgacaacttgacgaattacaccaacctccccccaacatcacccccacatccgactgaccgaacgcgctgtcattcaccaacaagaacaacgcccagcgggtgcagctgttcctgcgcggcctgttgggcagcatcccggtgttggtcaataagagtgggcaagatgataacagtaagtttaattccaccgaccaaaaatggtcttacaccgaattaa

SEQ ID NO: 683 - DNA, 1584 bp, Mycoplasma pneumoniae
gtggatgatataaccgcgcctcaaaccagcgcggggtcgtccagcggaactagtacgaacacaagtggttcgcgttcctttctcccgacgttttcgaatgtcggcgttggcctcaaagcgaatgtccagggcaccctcgggggcagacagacgacgactacggggaacaatattcccaaatgagccaccctcgaccaagccaacctccagctctgaacgggggcggggtgaaggaatgataagactacaagtggttcaaccggcaatgccaatgacaccaagttcacgagtgctacgggcagtgggagtgggcagggcagttcttcaggtacaaatacttccgcggggaatcctgatgggcttcaggctgataaagttgatcaaaacggtcaggtgaaaacaagcgttcaagaagccacttcaggggacaacttgacgaattacaccaacctcccccccgccaacctcacccccaccgctgattgaccgaacgcgctgtcattcaccaacaagaacaacgcgcagcgcgcccagctgttcctgcgcggcctgttgggcagcatcccggtgttggttaataagtccggccaagatgataacagtaagtttaaggcggaggaccaaaaatggtcctacaccgacttacagtcggaccaaaccaaactgaacctccccgcttacggcgaggtgaatgggttgttgaatccggcgttggtggaaacctattttgggaacacgcgagcgagtggttcggggtccaacacgaccagttcacccggtatcggttttaaaattcccgaacaaagtggcacaaacacaacgtcgaaggctgtgctgatcacccccgggttggcttgaacgccgcaagacgttggtaacatcgttgtcagtggcaccagcttcagcttccagctcggcgggtggttagttacgttcacggactttatcaaaccccgcgctggttacctcgggctccagttaacgggtctcgatgtaagtgaagcgacccaaagggagttaatttgggccaagcggccctgagcggcctttcgtggcagttgggtcaaccggctgggccgcgtggagagtgtgtgggatttcaagggggtgtgggcggatcaagctcagttggccgcgcaagcagctacaagtagtaccaccaccaccgcaacaggggctaccttaccggagcacccgaatgccctcgcgtaccaaattagctataccgacaaggattcgtacaaggcttccactcaaggttcgggtcaaaccaattcccaaaacaattcgccctacctccattttattaaacctaagaaagtcgaaagcacgacccaactcgaccagggcttaaaaaacctgttggaccccaaccaggttcgcaccaagctgcgccaaagctttggtacagaccattccacccagccccagccccaatcgctcaaaacaacgacaccggtatttgggaggagtagtggtaacctcagtagtgtgtttagtggtgggggtgctggagggggttcttcaggctcaggtcaatctggcgtggatctctcccccgttgaacgggtgagtggtcactaa

SEQ ID NO: 684 - DNA, 2214 bp, Mycoplasma pneumoniae
gtgttaaaacttgctgttggtatttttatttcccccacgctcaccaggtttagtaccgggttcaacctcgcggggtcggtgctcgaccaggtgttggattatgtgccctggattgggaatgggcacaggtatgggaataaccaccggggcgtggatgatataaccgcgcctaaaaccggcgcggggtcgtccagcggaactagtacgaacacaagtggttcgcgttcctttctcccgacgttctcgaatgtcggcgttggcctcaaagcgaatgtccagggcaccctgggtggcagtcagacgacgactacggggaaagatattcccaaatgacccaccctcgacccagccaacctccagctctgaacgggggcggggtgaaggaatgataaggcttcaaacaaacaaagtgacgaaaaccacaccacctttaaaagcgctacgggcagtggccagcagggtggttctacaacgggtggttcagcgggcaatcccgactcgttaaagcaggataagattagtaaatcaggtcagaacttaaccacgcaggacggcgcgccccagtctaattcgacgacggaatccgcgtcgaattatgatcacctcccccccaacctcacccccacatccgattgaccgaacgcgctgtcattcaccaacaagaacaacgcgcagcgcgcccagctcttcctccgcggcttgttgggcagcatcccggtgttggtgaatcgaagtgggtcagatgattccaacaaattccaagccaccgaccaaaaatggtcttacaccgacttaaagtcggaccaaaccaagctcaacctccccgcttatggtgaagtgaatgggttgttgaatccggcgttggtggaaacctattttgggacgacgcgagcgggtggttcggggtccaacacgaccagttcacccggtatcggttttaaaattcccgaacaaaataatgattcgaaggctgtgctgatcacccccgggttggcttgaacgccgcaagacgttggtaacctcgttgtcagtggtaccagcttgagcttccagttgggcgggtggctggtcaccttcacggactttgtcaaaccccgcgcgggttacctcgggctccagttaacgggcttggatgcaagtgatgcgacgcagcgcgccctcatttgggccaagcggccctgagcggcctttcgtggcagttgggtcaaccgcttgggccgggtcgagagtgtgtgggatttaaagggggtgtgacaagatcaagctcaggcggccgcgcaagcagctaccaccgccgccgcaacaggggacgccttaccggagcaccccaatgccctcgcgtaccaaattagctccaccgacaaggattcgtacaaggcttccactcaaagctccggtcaaaccaattcccaaaacacctccccctacctccatttgattaaacctaagaaagtcgaaaacacgacccaactcgaccagggcttaaaaacctgttggaccccaaccaggttcgcaccaagctgcgccaaagctttggtacagaccattccacccaagccaaaccccaatccctcaaaacaaccacaccggtgtttgggacgaatagtggtaacattggcagtgtgcttagtggtgggggtgctggaggagcagacagcaccaattcggtggacctctcccccgttgaacgggtgagtgggtggcttgtggggcaattacccagtgggggtggggggaatagtagtgaggatattaaaagtgtgcaagacactcctatttatatctatattcattagtatattctttttaaattgttccctcactttattcatatgaaccaccgcctccctcgcgacgggactcaccgtagtgggacacttcacaagtaccaccacgacgctcaagcgccagcaatttagctacacccgccctgacgaggtcgcgctgcgccacaccaatgccatcaacccgcgcttaaccccgtgaacgtatcgtaacacgagcttttcgtccctccccctcacgggtgaaaaccccggggcgtgggccttagtgcgcgacaacaccgccaagggcatcactgccggcagtggcagtcaacaaaccacgtatgatcccacccgaaccgaagcggctttgaccaccgccaccacctttgtgttacgccgatacgacctcgccgggcgttgtacgacctcgacttttcgaagttaa

SEQ ID NO: 685 - DNA, 1398 bp, Mycoplasma pneumoniae
gtgttggattatattccctggattgggaatgggcacagatatgggaatgaccaccggggtagcaacagtagtacgagtggggtaacaacccagggacaacaatcgcaaaatgcatccggaaccgaacccgcatccactttttcgaatgtcggcgttggcctcaaagcgaatgtccagggcaccctgggtggcagtcagacgacgactacggggaaagatattcctaaatgacccaccctcgaccaagccaacctccagctctgaacgggggcggggtggcggaatgataaggcttcaagtggacaaagtgacgaaaaccacaccaagttcacgagcgctacgggcagtgggcagcagggcagttcttcaggtacaactaattccgcgggcaatcccgactcgttaaagcaggataaggttgataaaagtggtgattcggtaacggttgcagaaaccacttcaggggacaacttgacgaattacaccaacctccctcccaacctcacccccaccgctgattgaccgaacgcgctgtcattcaccaacaagaacaacgcgcagcgcgcccagctcttcctccgcgccctgttgggcagcatcccggtgttggtgaataagagtggccaagatgattccaacaagttccaagccaccgaccaaaaatggtcttacaccgaattaaagtcggatcaaaccaagctcaacctccccgcttacggggaggtgaatgggttgttgaatccggcgttggtggaggtgtacggtctgagttccactcaaggttctagcaccggagccggtggcgctggaggtaacaccggaggcgacaccaatacccagacttatgcacgacccggaatcggctttaaattaccctccacggactcggaatcttccaaagccaccctgatcacccccgggttggcttgaacagcgcaagatgtcggtaacctcgttgtcagtggtaccagcttgagcttccagctcggcgggtggttggttaccttcacggattttatcaaaccccggtcgggttacctcgggctccagttaacgggcttggatgcaaatgacagcgaccaaagggagttaatttgagcccccccggccctgaaccgcctttcgtggcagttgggtcaaccgcttgggccgcgtggagagtgtgtgggatttcaagggggtgtgggcggatcaagctcggtccgactcgcaagcagctacaagtaccaccaccgcaacgaaggctaccttatcggagcacaccaatgctttggcctttcaggtgagttataccgaccaggattcgtacaaggcttccactcaaagctccggccaaaaccaaaacacctccccctacctgcacttggtgcaggggaaaaaagtaggttcctctgataa

SEQ ID NO: 686 - DNA, 1044 bp, Mycoplasma pneumoniae
ttgttgggcagcatcccggtgttggtgaatcgaagtgggtccgattccaacaaattccaagccaccgaccaaaaatggtcctacaccgacttacagtcggaccaaaccaaactgaacctctccgcttacggtgaggtgaatgggttgttgaatccggctttggtagaaacctattttgggacgacgcgtacgtctagcactgcgaaccaaaacagtacaaccgtccccggtatcggttttaaaattcccgaacaaaataatgattccaaagccaccctgatcacccccgggttggcttgaacgccccaggacgtcggtaacctcgttgtcagtggcaccacggtgagcttccagctcggcgggtggctggtcaccttcacggactttgtcaaaccccgcgcgggttacctcgggctccagttaagtggcctgaatgccagtgacagcgaccaaagggagttaatttgggccccccggccctgagcggcctttcgtggcagttgggtcaaccggttgggccgcgtggagagtgtgtgggatttgaagggggtgtgggcggatcaagctcagttggccgcgcaagcagctacaagtagtaccaccaccaccgcaacaggggctaccttaccggagcacccgaatgctttggcgtaccaaattagctataccgacaaggattcgtacaaggcttccactcaaggttcgggtcaaaccaattcccaaaacaattcgctctacctccatttgattaaacctaagaaagtcgaaagcacgacccaactcgaccagggcttaaaaaacctgttggaccccaaccaggttcgcaccaagctgcgccaaagctttggtacagaccattccacccagccccagccccaatcgctcaaaacaacgacaccggtgtttggagccatgagtggtaacctcggcagtgtgcttagtggtgggggtgctggaggagcaggcagcaccaattcggtggacctctcccccgttgaacgggtgagtgggtcactaaccattaataggaatttttcttattaa

SEQ ID NO: 687 - DNA, 1242 bp, Mycoplasma pneumoniae
atgggccagcagggacaatcaggtacctccgcggggaatccagactcgttaaagcaggataagattagtaagagtggggatagtttaaccacgcaggacggcaatgcgaccggtcaacaagaggccactaactacaccaacctcccccccaacctcacccccaccgctgattgaccgaacgcgctgtcattcaccaacaagaacaacgcgcatcgcgcccagctcttccttcgcggcttgttgggcagcatcccggtgttggtgaatcgaagtgggtccgattccaacaaattccaagccaccgaccaaaaatggtcctacaccgacttacagtcggatcaaaccaagctgaacctccccgcttacggtgaggtgaatgggttgttgaatccggcgttggtggaaacctattttgggaacacgcgagcgggtggttcggggtccaacacgaccagttcacccggtatcggttttaaaattcccgaacaaaataatgattccaaagccaccctgatcacccccgggttggcttgaacgccccaggacgtcggtaacctcgttgtcagtggcaccagcttgagcttccagctcggcgggtggctggtcagcttcacggactttatcaaaccccgcgcgggttatttgggcctccagttaagtggcctggatgccagtgacagcgaccaaagggagttaatttgggccaagcggccctgagcggcctttcgtggcagttgggtcaaccggctgggccgcgtggagagtgtgtgggatttaaagggggtgtgggcggatcaagctcagttggccgcgcaagcagctacaagtgaagcttccgggtcagctttggcacctcacccgaatgctttggcgtttcaggtgagtgtggtggaagcgagtgcttacagctcttcaacctcaagttcgggttccgggtcaagttcaaacacctccccctacctccatttgattaaacctaagaaagtcgaaagcacgacccaactcgaccagggcttaaaaaacctgttggaccccaaccaggttcgcaccaagctgcgccaaagctttggtacagaccattccacccagccccaatcgctcaaaacaacgacaccggtatttgggacgagtagtggtaacattggcagtgtgcttagtggtgggggtgctggagggggttcttcaggctcaggtcaatctggtgtggacctctcccccgttgaacgggtgagtggtcactaa

SEQ ID NO: 688 - DNA, 771 bp, Mycoplasma pneumoniae
ttgggcctccagttaagtggcctggatgccagtgacagcgaccaaagggagttaatttgggccaagcggccctgagcggcatttcgtggcagttgggtcaaccggttgggacgggtcgagagtgtgtgggatttgaagggggtgtgggcggatcaagctcacagcgcggtgtccgagtcgcaagcagctacaagtagtaccaccaccaccgcaacaggggacaccttaccggagcacccgaatgccctcgcgtaccaaattagctccaccgacaaggattcgtacaaggcttccactcaaggctccggtcaaaccaattcccaaaacacctccccctacctgcatttgattaaacctaaaaaagttactgcttccgacaagttagacgacgatcttaaaaacctgttggaccccaacgaggttcgggtgaagctgcgccaaagctttggtacagaccattccacccaaccccaaccccaacccctcaaaacaacgacaccggtgtttgggacgaatagtggtaacctcggtagtgtgcttagtggtgggggtaccacgcaggactcaagcaccaccaatcaactgtcacccgttcaacgggtgagtgggtggcttgtggggcagttaccaagcacgagtgacggaaacacctcctccaccaacaacctcgcgcctaatactaatacggggaatgaggtggtgggggtgggagatttgtctaagcgagcttccattgaatcaagtcgtttgtgaatagcattaaaaccttag

SEQ ID NO: 689 - DNA, 1317 bp, Mycoplasma pneumoniae
gtgcgcgataacactgccaagggcatcactgccggcagtggcagtcaacaaaccacgtatgatcctgcgcgaaccgaggccaccttgaccaccaccacctttgcgctgcgccggtatgacctcgccgggcgcgccttatacgacctcgacttttcgaagttaaacccacaaacgccaacgcgtgatgccaactgccagatcacctttaacccctttggcggctttggtttgagtggcagtgcaccccaacagtgaaacgaggtcaaaaacaaggtccccgtcgaggtggcccaagaccccaccgatccttatcggtttgccgttttactcgtgccgcgcagtgtggtgtactatgagcagttgcaaaggggattagcgctccctaaccaagggagttcgtcaggctccggtcaacaaaacaccaccattggcgcgtatgggctgaaggtgaagaacgccgaggcggacaccgcaaagagcaatgaaaaactccagggcgatgaatccaagtcttccaatggatcttcaagcacttccaccaccacccaacgtggttcgaccaattccgacaccaaagtcaaggctttaaaaatagaggtgaaaaagaaatcggactcggaggacaatggtcagctgcagttagaaaaaaatgatctcgccaacgctcccattaagcggggcgaggagtcgggtcagtccgtccaactcaaggcggacgattttggtactgccccttccagttcgggatcaggcggcaactccaaccccggttcccccaccccctgaaggccgtggcttgcgactgagcaaattcacaaggacctccccaaatgatccgcctcgatcctgattctgtacgatgcgccttatgcgcgcaatcgtaccgccattgatcgcgttgatcacttggatcccaaggtgatgaccgcgaactatccgcccagttgaagaatgcccaagtgaaaccaccacgggttgtgggactgaaaggcgcgcgatgttttgttccaaaccaccgggtttgatgaaagtaatacttcgaacaccaagcagggctttcaaaaggaagctgactccgacaagtcggcccccatcgccctcccgtttgaagcgtacttcgccaacattggcaacctcacctggttcgggcaagcgcttttggtgtttggtggcaatggccatgttaccaagtcggcccacaccgcgcctttgagtatttggctttatatatatttagtaaaggcagtcacttttaggttgcttttagctaactctttattatcaaaaagcaacatatataaaaaaacagctaattaa

SEQ ID NO: 690 - DNA, 1269 bp, Mycoplasma pneumoniae
gtgcgcgataacattgccaagggcatcactgccggtagtaacacccaacaaaccacgtatgatcccacccgaaccgaggccaccttgaccaccgccaccacctttgcgttacgccggtatgacctcgccgggcgcgccttatacgacctcgatttttcgaagttaaacccacaaacgcccacgcgcgaccaaaccggtcagatcacctttaacccctttggcggctttgggctgagtggggctgcaccccaacagtgaaacgaggtcaaggataaggtccccgtcgaggtggcccaagacccctccaatccttatcggtttgccgttttactcgtgccgcgtagcgtggtgtactatgagcagttgcagcgggggttagcgctccctaaccaagggagttcgtcaggctccggtcaacaaaacaccaccattggcgcgtatgggctgaaggtgaaaaacgccgaggcggacaccgcgaagagcaatgaaaaactccagggctatgaatccaagtcttccaatggatcttcaagcacttccaccacccaacgtgggggttcgtcaaatgaaaacaaagtcaaggcgttgcaggtggcggtgaaaaagaaatccgggagtcagggcaactccggtgaccaaggcaccgaacaggtggaacttgaatctaatgatttagccaacgccccgattaaacgaggctccaataacaaccagcaagtccaactcaaggcggacgattttggtactgccccttccagttcgggatcaggcacccaagatggcacccccaccccctgaacgccgtggttaacgactgagcaaattcacaacgaccccgccaaattcgccgcctcgatcctcattctgtacgatgcgccttatgcacgcaaccgtaccgccattgaccgcgttgatcacttggatcccaaggtgatgaccgcgaactatccgcccagttgaagaacgcccaagtgaaaccaccacggtttgtgggactgaaaggcgcgcgatgttttgctccaaaccaccgggttcttcaacccgcgccgccaccccgagtggtttgatggcgggcagacggtcgcggataacgaaaagaccgggtttgatgtggataactccgaaaacaccaagcagggctttcaaaaggaagctgactccgacaagtcggccccgatcgccctcccgtttgaagcgtacttcgccaacattggcaacctcacctggttcgagcaagcgcttttggtgtttgggatttgtttgtcttaa

SEQ ID NO: 691 - DNA, 384 bp, Mycoplasma pneumoniae
atgctttggcctttcaggtgagtgtggtggaagcgagtgcttacaagccaaacacgagctccggccaaacccaatccactaacagttccccctacctgcacttggtgaagcctaagaaagttacccaatccgacaaagttagacgacgatcttaaaaacctgttggaccccaacgaggttcgcgccagaatgctcaaatcatttggtacagaaaatttcacccaaccccaaccccaaccccaagccctcaaaacaacgacaccggtatttgggacgagtagtggtaacctcggtagtgtgcttagtggtggggggtaccacgcagggctcaagcaccaccaatcaactgtcacccgttcaacgggtgagtgggtggaccgctaa

SEQ ID NO: 692 - DNA, 1287 bp, Mycoplasma pneumoniae
gtgcgcgacaacagcgccaagggcatcactgccggtagtgaaagtcaacaaaccacgtatgatcccactcgaaccgaagcggctttgaccgcatcaaccacctttgcgttacgccggtatgacctcgccgggcgcgccttatacgacctcgactttagtaggttaaacccacagacaccaacgcgcgaccaaaccgggcagatcacctttaacccctttggcggctttggtttgagtggggctgcaccccaacagtgaaacgaggtcaaaaacaaggtccccgtcgaggtggcccaagacccctccaatccttatcggtttgccgttttactcgtgccgcgtagcgtggtgtactatgagcagttgcagcgggggttagcgctccctaaccaagggagttcgtcaggctccggtcaacaaaacaccaccattggcgcgtatgggctgaaggtgaagaacgccgaggcggacaccgcgaagagcaatgaaaaactccagggcgatgaatccaagtcttccaatggatcttcaagcacttccaccaccacccaacgtgggggttcgtcaggggacaccaaagtcaaggcgttgcaggtggcggtgaaaaagaaatccgggagtcagggcaactccggtgaacaaggcaccgaacaggtggaacttgaatctaatgatctcgccaacgctcccattaagcggggcgaggagtcgggtcagtccgtccaactaaaggcagccgacttcggcaccaccccatccagttcgggatcaggcggcaactccaaccccggttcccccaccccctgaaggccgtggcttgcgaccgagcaaattcacaaggacctccccaaatgatccgcctcgatcctgattctgtacgatgcgccttatgcgcgcaatcgtaccgccattgatcgcgttgatcacttggatcccaaggtgatgaccgcgaactatccgcccagttgaagaacgcccaagtgaaaccaccacgggttgtgggactgaaaggccagagatgttttgctccaaaccaccgggttcttcaactcgcggcgccaccccgagtggtttgaccagggccaagcggtcgcggataatacccaaaccgggtttgatacagatgacaccgataataaaaaaacaaggctttcaaaaggaagctgactccgacaagccggccccgatcgccctcccgtttgaagcgtacttcgccaacattggcaacctcacctggttcgggcaagcgcttttggtgtttgggatttgtttgtcttaattaactaa

SEQ ID NO: 693 - DNA, 450 bp, Mycoplasma pneumoniae
atgtttggcttgaaggtgaagaacgccgaggcggacaccgcgaagagcaatgaaaaactccagggcgctgaggccactggttcttcaaccacatctggatctggccaatccacccaacgtgggggttcgtcaggggacaccaaagtcaaggcgttgcaggtggcggtgaaaaagaaatccgggagtcagggcaactccggtgaccaaggcaccgaacaggtggaacttgaatctaatgatttagccaacgccccgattaaacggggctccaatccagcaagtccaactcaaggcagccgacttcggcaccaccccatccagttcggaatctggtcaatcaggcacccccaccccctgaaggccgtggcttgcgaccgagcaaattcacaaggacctccccaaatgatccgcctcgatcctcattctgtacgatgcgccttatgcctttaa

SEQ ID NO: 694 - DNA, 813 bp, Mycoplasma pneumoniae
atgtttggcttgaaggtgaaggatgcaaccgtggatagttcgaagcaatcaacggaaagcttaaagggcgaagaatcgagttccagttccaccacatcttccacctccaccacccaacgtgggggttcgtcaggggacaccaaagtcaaggcgttgcaggtggcggtgaaaaagaaatcggactcggaggacaatggtcagatcgaacttgaaaccaacaacctcgccaacgccccgattaaacggggctccaataacaaccagcaagtccaactcaaggcggacgattttggtacttccccttccagttcggaatctggtcaatcaggcacccccaccccctgaacgccgtggcttgcgaccgagcaaattcacaaggacctccccaaatgatccgcctcgatcctgattctgtacgatgcgccttatgcgcgcaatcgtaccgccattgatcgcgttgatcacttggatcccaaggtgatgaccgcgaactatccgcccagttgaagaacgcccaagtgaaaccaccacgggttgtgggactgaaaggcgcgcgatgtcctggtccaaaccaccgggttcttcaacccgcgccgccaccccgattggtttgaccagggccaagcggtcgcggagaatacccaaaccgggtttgatacagatgacaccgataataaaaagcagggctttcgcaaacaaggcgaacaatcccctgcccccatcgccctcccgtttgaagcgtacttcgccaacattggcaacctcacctggttcgggcaagcgcttttggtgtttgggatttgtttgtcttaa

SEQ ID NO: 695 - DNA, 942 bp, Mycoplasma pneumoniae
atgggcagtcaaaaccagggttctacaacaactacctcagcgggcaatcccgattctttagttactgataaagttgatcaaaaaggtcaggtgcaaacaagtggtcaaaatttaagtgataccaactacaccaacctctcccccaacttcacccccacatccgactgaccgaacgcgctcagcttcaccaacaagaacaacgcgcagcgcgcccagctgttcctgcacggcttgttgggcagcatcccggtgttggttaataagagtggcgaaaataacgaaaaattccaagccaccgaccaaaaatggtcctacaccgaattaaagtcggatcaaaccaagctcaacctccccgcttatggtgaggtgaatgggctgttgaatccggcgttggtggaaacctattttgggacgacgcgtacgtctagcactgcgaaccaaaacagtacaaccgtccccggtatcggttttaaaattcccgaacaaaataatgattcaaaggctgtgctgatcacccccgggttggcttgaacgccccaggacgttggtaacctcgttgtcagtggcaccagcttcagcttccagctcggcgggtggctggtcagcttcacggactttgtcaaaccccgcgcgggttacctcggactccagttaacgggcttggatgcaagtgatgcgacgcagcgcgccctcatttgggcccccccggccctgagcggcctttcgtggcagttgggtcaaccggttgggccgcgtggagagtgtgtgggatttgaagggggtgtgggcggatcaagctcagtccgactcgcaaggatctaccaccaccgcaacaggggctaccttaccggagcacccgaatgctttggcctttcaggtgagtgtggtggaagcgagtgcttacaagccaaacacgagctccggccaaacccaatccactaa

SEQ ID NO: 696 - DNA, 390 bp, Mycoplasma pneumoniae
atgagttttggtttagtgggcactgttaataataacggttggaaatcgccgtttcgacatgaaacaaaataccgagcagggtatgataagttcaagtattacaaaacccactaccggggtgcaaaaaaagctggaaccaatgatgatcgatggagatgaactgcttggtttgaccttgactttgcccaccaaaagatagtgctcattgaaaggggtgaacttcaccgtcaagcagatttaaaaaaatctgaccccgcaacaaacgaaacttccaaaaccgtttggggtagcattaaagaaaagctgttacaaaacgtcaacaacctccactcagagaaaggagtattcttatggttccgtcaatctggttttacaactactagaaactag

SEQ ID NO: 697 - DNA, 843 bp, Mycobacterium tuberculosis H37Rv
atggctgaaccgttggccgtcgatcccaccggcttgagcgcagcggccgcgaaattggccggcctcgtttttccgcagcctccggcgccgatcgcggtcagcggaacggattcggtggtagcagcaatcaacgagaccatgccaagcatcgaatcgctggtcagtgacgggctgcccggcgtgaaagccgccctgactcgaacagcatccaacatgaacgcggcggcggacgtctatgcgaagaccgatcagtcactgggaaccagtttgagccagtatgcattcggctcgtcgggcgaaggcctggctggcgtcgcctcggtcggtggtcagccaagtcaggctacccagctgctgagcacacccgtgtcacaggtcacgacccagctcggcgagacggccgctgagctggcaccccgtgttgttgcgacggtgccgcaactcgttcagctggctccgcacgccgttcagatgtcgcaaaacgcatcccccatcgctcagacgatcagtcaaaccgcccaacaggccgcccagagcgcgcagggcggcagcggcccaatgcccgcacagcttgccagcgctgaaaaaccggccaccgagcaagcggagccggtccacgaagtgacaaacgacgatcagggcgaccagggcgacgtgcagccggccgaggtcgttgccgcggcacgtgacgaaggcgccggcgcatcaccgggccagcagcccggcgggggcgttcccgcgcaagccatggataccggagccggtgcccgcccagcggcgagtccgctggcggcccccgtcgatccgtcgactccggcaccctcaacaaccacaacgttgtag

SEQ ID NO: 698 - DNA, 684 bp, Mycobacterium tuberculosis H37Rv
atgcgttatctgatagcgaccgcagtgctcgttgctgtggtcctggtgggctggccggcggctggtgcgccgccgtcatgcgccggcctgggcggcactgtgcaggccggccagatctgccatgtgcacgcctcgggccctaagtacatgctggatatgacatttcctgtcgactatcccgaccagcaggcgctgaccgactacatcacgcaaaaccgcgacgggttcgtcaacgtcgcgcaggggtccccgctgcgagaccagccctaccaaatggacgccaccagcgaacagcacagctccggccagccgccgcaggccacccgcagcgtagtgctcaaattcttccaggacctcggtggggcacatccgtccacctggtacaaggccttcaactacaacctcgcgacctcgcagcccatcaccttcgacacgttgttcgtgcccggcaccacgccactggacagcatctaccccatcgttcagcgcgagctggcacgtcagaccggtttcggtgccgcgatattgccttcgaccggcctcgacccggctcactaccagaactttgctatcaccgacgacagtctgattttctacttcgcccagggtgagctgctgccgtcgtttgtcggcgcttgccaagcccaggtgccgcgcagcgccattccgccgctggcaatctaa

SEQ ID NO: 699 - DNA, 507 bp, Mycobacterium tuberculosis H37Rv
atgaagatggtgaaatcgatcgccgcaggtctgaccgccgcggctgcaatcggcgccgctgcggccggtgtgacttcgatcatggctggcggcccggtcgtataccagatgcagccggtcgtcttcggcgcgccactgccgttggacccggcatccgcccctgacgtcccgaccgccgcccagttgaccagcctgctcaacagcctcgccgatcccaacgtgtcgtttgcgaacaagggcagtctggtcgagggcggcatcgggggcaccgaggcgcgcatcgccgaccacaagctgaagaaggccgccgagcacggggatctgccgctgtcgttcagcgtgacgaacatccagccggcggccgccggttcggccaccgccgacgtttccgtctcgggtccgaagctctcgtcgccggtcacgcagaacgtcacgttcgtgaatcaaggcggctggatgctgtcacgcgcatcggcgatggagttgctgcaggccgcagggaactga

SEQ ID NO: 700 - DNA, 912 bp, Mycobacterium tuberculosis H37Rv
atgacctactcgccgggtaaccccggatacccgcaagcgcagcccgcaggctcctacggaggcgtcacaccctcgttcgcccacgccgatgagggtgcgagcaagctaccgatgtacctgaacatcgcggtggcagtgctcggcctggctgcgtacttcgccagcttcggcccaatgttcaccctcagtaccgaactcggcggaggtgatggcgcagtgtccggtgacactgggctgccggtcggggtggctctgctggctgcgctgcttgccggggtggctctggtgcctaaggccaagagccatgtgacggtagttgcggtgctcggggtactcggcgtatttctgatggtctcggcgacgtttaacaagcccagcgcctattcgaccggttgggcattgtgggttgtgttggctttcatcgtgttccaggcggttgcggcagtcctggcgctcttggtggagaccggcgctatcaccgcgccggcgccgcggcccaagttcgacccgtatggacagtacgggcggtacgggcagtacgggcagtacggggtgcagccgggtgggtactacggtcagcagggtgctcagcaggccgcgggactgcagtcgcccggcccgcagcagtctccgcagcctcccggatatgggtcgcagtacggcggctattcgtccagtccgagccaatcgggcagtggatacactgctcagcccccggcccagccgccggcgcagtccgggtcgcaacaatcgcaccagggcccatccacgccacctaccggctttccgagcttcagcccgccgccaccggtcagtgccgggacggggtcgcaggctggttcggctccagtcaactattcaaaccccagcgggggcgagcagtcgtcgtcccccgggggggcgccggtctaa

SEQ ID NO: 701 - DNA, 1215 bp, Mycobacterium tuberculosis H37Rv
atgaaatgtccaggcgtctccgactgcgttgcgaccgtaaggcacgataacgtgtttgctattgctgctggtttgcgttggtcggccgctgtaccgccgctacacaaaggggacgctgtgaccaaactgctcgtcggggccatcgcgggcggaatgctagcttgcgcagctatattgggcgacggaatcgcttcggccgatactgcgttgatagtacccggtaccgcaccgtccccgtacgggccactcaggtcgctctatcatttcaatcccgcgatgcagcctcagatcggcgcgaattactacaaccccaccgctacccgccacgtcgtttcatatccaggcagcttttggcctgtcacaggcttgaattcgcccaccgtcggcagttctgtcagtgccgggacgaacaatctcgatgcggcgatccgcagcactgacggaccaatcttcgtggccgggttatcacagggcacgctcgtgcttgaccgcgagcaggcacggttagcgaatgacccgacggctcctccccctgggcaactcacattcatcaaggccggcgaccctaacaatcttctttggcgggcgtttaggccgggaacccacgtgccgatcatcgactacaccgttccggccccagcggaaagccagtacgacacaatcaatatcgtgggccagtacgacattttttctgacccgcctaatcgtccgggcaacctactcgctgacctcaatgcgattgccgcgggcggatactacggccacagcgccaccgcattctcggacccagctcgcgttgcgcctagggacattacgacgacaacgaacagtttgggtgcgacgaccacgacctacttcatccggaccgatcagctacctctggtgcgggcgctggtggacatggcgggcctgcccccgcaggcggcgggaacagttgatgccgcactgcggcccataattgacagggcttatcagcccggaccagcacccgctgtgaacccgcgtgatttggtccagggcatccgcggtatccccgccatcgcccctgccatcgccatccctatcggcagcaccaccggggccagtgccgccaccagcaccgctgccgccacggcagcagcaacaaatgcgctccgcggggccaacgtgggcccgggcgccaacaaggcgttgtcgatggtccggggtttgctacccaaagggaagaagcactag

SEQ ID NO: 702 - DNA, 735 bp, Mycobacterium tuberculosis H37Rv
gtgagcctgctaccaaccctgcagtccttcctaccgccgcccttcgacgccattccgaaccccatcgaggatcttgacgttctcgtagccgcagctgtagccgtcgcggctggcagtttgggggtatcggcggcgcagctcggcgagatctaccgccacgacgtggtcgacgaggcccaaaaggcgccgcattgcccagccgaatccgaccagacacccgctggggccgcgggtgacggggatctccctgaggtcggaggacgggtcaccagcccgccacagccgccggtcgccgcgctcaccggctactccgctaacatcggcggactctccgtgccgcacagctggaatcttccgccagcggtgcgccaagttgcggcgatgttccccggcgcgactccgatgtatatgacggggagttcggacggctcctacgccggcctggcagcggcgggtttggccggcaccggtctggccggtcttgccgcccgcggtggctccgcgccgaccccggctgcagccgccccggccggagccggcggagccggcccggctgccaccaggcccgccgcccagcagacgcccgcggtccccgcggcggccgccgggtcagccatacctggcctaccgcccggtttgccgcccggcgtggttgccaaccttgcggcgaccctggcggcgatccccggagcgaccatcatcgtggtaccgccgtccccgaacgccaatcaatag

SEQ ID NO: 703 - DNA, 1647 bp, Mycobacterium tuberculosis H37Rv
atggacgtcgctttgggggttgcggtcacggatcgggtcgcgcgtctggcgctggtcgactcggctgcgcccggcaccgtgatcgaccagttcgtgctcgatgtggccgagcacccggtcgaggtgttaaccgagaccgtggtgggcacggatcggtcattggccggcgaaaaccaccggctggtcgctacccggctgtgttggccggatcaggccaaagctgacgagctgcagcacgcactgcaggactccggggtccacgacgttgccgtgatatccgaggcgcaggccgccacggcgctggtcggggcggcacatgccggctctgccgtgctgttggtgggtgatgagacggcaaccttatcggtggttggtgacccggacgcgccgccgacgatggtggccgtcgcgccggtggcgggcgccgacgccacatcgaccgtcgataccctgatggcccggctcggcgaccaggccctcgccccgggggatgtcttcctggtgggtaggtccgccgagcacaccacggttcttgccgaccagctgcgcgcggcgtcgacgatgcgcgtgcagactcccgacgaccccacgttcgcgctggcccgtggcgcggcgatggcggccggcgccgctacgatggcgcacccggccctggtcgcggatgcgaccacttcgctcccccgggccgaggcggggcaatcgggttctgaaggcgagcagctggcgtactcgcaggccagcgattacgagctgcttccggtcgacgaatatgaggaacacgacgaatacggggcagccgcggatcgctcggcgccgttgagccgacggtcgctgctgatcggcaacgctgtcgtggcctttgcggtgatcggtttcgcctcgctggcggtggcggtggcggtcaccatccgaccgaccgcggcctcaaaaccggtagagggacaccaaaacgcccagccagggaagttcatgccgttgttgccgacgcaacagcaggcgccggtcccgccgcctccgcccgatgatcccaccgctggattccagggcggcaccattccggctgtacagaacgtggtgccgcggccgggtacctcacccggggtgggtgggacgccggcttcgcctgcgccggaagcgccggccgtgcccggtgttgtgcctgccccggtgccaatcccggtcccgatcatcattcccccgttcccgggttggcagcctggaatgccgaccatccccaccgcaccgccgacgacgccggtgaccacgtcggcgacgacgccgccgaccacgccgccgaccacgccggtgaccacgccgccaacgacgccgccgaccacgccggtgaccacgccgccaacgacgccgccgaccacgccggtgaccacgccaccaacgaccgtcgccccgacgaccgtcgccccgacgacggtcgctccgaccaccgtcgccccgaccacggtcgctccagccaccgccacgccgacgaccgtcgctccgcagccgacgcagcagcccacgcaacaaccaacccaacagatgccaacccagcagcagaccgtggccccgcagacggtggcgccggctccgcagccgccgtccggtggccgcaacggcagcggcgggggcgacttattcggcgggttctga

SEQ ID NO: 704 - DNA, 519 bp, Mycobacterium tuberculosis H37Rv
ttgaagaacgcccgtacgacgctcatcgccgccgcgattgccgggacgttggtgaccacgtcaccagccggtatcgccaatgccgacgacgcgggcttggacccaaacgccgcagccggcccggatgccgtgggctttgacccgaacctgccgccggccccggacgctgcacccgtcgatactccgccggctccggaggacgcgggctttgatcccaacctccccccgccgctggccccggacttcctgtccccgcctgcggaggaagcgcctcccgtgcccgtggcctacagcgtgaactgggacgcgatcgcgcagtgcgagtccggtggaaactggtcgatcaacaccggtaacggttactacggcggcctgcggttcaccgccggcacctggcgtgccaacggtggctcggggtccgcggccaacgcgagccgggaggagcagatccgggtggctgagaacgtgctgcgttcgcagggtatccgcgcctggccggtctgcggccgccgcggctga

SEQ ID NO: 705 - DNA, 531 bp, Mycobacterium tuberculosis H37Rv
atgacgcggctgataccgggttgcacgctcgtcgggctgatgctgacgttactgcccgcgcccacctcggcggccgggagcaacaccgccaccaccctgttcccggtcgacgaggtcacccagctggagacgcacaccttcctcgattgccaccccaacggcagctgcgacttcgtcgctggagcaaatctgcgcacacccgacggcccgacgggctttccgcccgggctgtgggcgcgccaaaccaccgagatccgttcgacgaaccggttggcctatctggacgcgcacgccaccagccagttcgaacgggtaatgaaggcgggcggatccgacgtgatcaccaccgtctacttcggcgagggtccgccggacaaataccagaccaccggggtcatcgactcgaccaattggtcgaccggtcaaccgatgaccgacgtcaacgtcatcgtgtgtacacacatgcaggtggtctacccgggggtcaacctcacctcgcccagcacctgcgcgcaagccaacttttcctag

SEQ ID NO: 706 - DNA, 465 bp, Mycobacterium tuberculosis H37Rv
atgacaccgggtttgcttactactgcgggtgctggccgaccacgtgacaggtgcgccaggatcgtatgcacggtgttcatcgaaaccgccgttgtcgcgaccatgtttgtcgcgttgttgggtctgtccaccatcagctcgaaagccgacgacatcgattgggacgccatcgcgcaatgcgaatccggcggcaattgggcggccaacaccggtaacgggttatacggtggtctgcagatcagccaggcgacgtgggattccaacggtggtgtcgggtcgccggcggccgcgagtccccagcaacagatcgaggtcgcagacaacattatgaaaacccaaggcccgggtgcgtggccgaaatgtagttcttgtagtcagggagacgcaccgctgggctcgctcacccacatcctgacgttcctcgcggccgagactggaggttgttcggggagcagggacgattga

SEQ ID NO: 707 - DNA, 633 bp, Mycobacterium tuberculosis H37Rv
atgatgcaacaagcggtgtcgggcattaccggcgcgctcggcggcgcggtcggcggcgtcatgggcccactcacgcagcttccccagcaggccatgcaagcggggcagggagcaatgcagccgctgatgagtgcgcttcaacagacctatggcgcggagggactggacgtcgcggacggggcgcggctggtggacagcatcgaaggtgagcccggcctcggcggcgagccgggcgctggtgacgtcggcgccggcggcgggggtggtggcaccaccccgacgggctatctgggtcccccacccgtgccgacgtcgtcgccaccgacgactccagccggggcgccggccaagtcggtgacgccggacccggttagtggcaccccgcgggcgtcggggccggccggcatgaccggcatgccgatggtgccgccgggcgcgttgggtgcgggcgcggaaggagccaataaggacaagccggtcgagaagcgggtgacgggctgtgccgaatggtcaaccggtcaagggccgcttaacagtaccgccgagtgttccggtgaaatctgccgacgacaagccggtggtcaccaagtcgacgcgacggatccttgttgtgccgaacgacgacaaggttaa

SEQ ID NO: 708 - DNA, 408 bp, Mycobacterium tuberculosis H37Rv
atgattcgcgaactggtcaccaccgctgcgatcacgggtgccgcgatcggtggggcgccagtcgcgggcgcagacccgcagcgttatgacggcgatgtgccggggatgaactatgacgcttcgctgggcgccccatgctccagctgggagcgcttcatttttggacgaggcccctccggtcaggccgaagcctgtcattttccgcctcctaaccagttcccgccggccgaaaccggctactgggtgatctcctacccgctatacggcgtccagcaggtcggtgcgccgtgtccgaagccgcaggcggccgcgcagtctccggatgggttgccgatgctgtgtctgggagcccgtggatggcagccgggatggtttaccggggccgggttcttccctccggagccataa

SEQ ID NO: 709 - DNA, 828 bp, Mycobacterium tuberculosis H37Rv
atgaaaaccacaggcacaactatcaaactcggcatcgtctggttggtgctgtcggtgttcaccgtgatgatcatcgtggtgttcgggcaggtgcggttccatcacaccaccgggtactccgcggtgttcacccatgtcagcgggctgcgggccgggcaatttgtccgcgctgcgggcgtagaggtcggcaaggtcgccaaggtaacgctgatcgacggggacaagcaagtattggtggacttcaccgtggatcgctcgctgtcactggatcaggcgacgaccgcctcgatccgctacctcaacctgatcggcgaccggtaccttgagctcggccgcggtcacagcggtcagcggctggcgccgggtgccacgatcccgctcgagcacacccatccggccttggatctcgacgctctgctcggcgggtttcgcccactcttccaaacgttggacccagacaaggtcaacagcatcgcctcctcgatcatcaccgtgttccaagggcaaggcgccaccatcaacgacatcctcgaccagaccgcctcgctgacggcaacgctggccgaccgggaccatgcgataggtgaggtcgtcaacaacttgaacaccgtgctggccaccaccgtcaagcatcaaacggaattcgaccgcacggtcgacaagctagaggtgctgatcactggactgaagaacagggcggacccgctggccgcggcggcggcacacatcagcagcgccgcgggaaccctagccgacctgctggggcggatcgtccattgctgcacagcagcttcgggcacctcgagggcatccagcagccgctcatag

SEQ ID NO: 710 - DNA, 654 bp, Mycobacterium tuberculosis H37Rv
atgactccacgcagccttgttcgcatcgttggtgtcgtggttgcgacgaccttggcgctggtgagcgcacccgccggcggtcgtgccgcgcatgcggatccgtgttcggacatcgcggtcgttttcgctcgcggcacgcatcaggcttctggtcttggcgacgtcggtgaggcgttcgtcgactcgcttacctcgcaagttggcgggcggtcgattggggtctacgcggtgaactacccagcaagcgacgactaccgcgcgagcgcgtcaaacggttccgatgatgcgagcgcccacatccagcgcaccgtcgccagctgcccgaacaccaggattgtgcttggtggctattcgcagggtgcgacggtcatcgatttgtccacctcggcgatgccgcccgcggtggcagatcatgtcgccgctgtcgcccttttcggcgagccatccagtggtttctccagcatgttgtggggcggcgggtcgttgccgacaatcggtccgctgtatagctctaagaccataaacttgtgtgctcccgacgatccaatatgcaccggaggcggcaatattatggcgcatgtttcgtatgttcagtcggggatgacaagccaggcggcgacattcgcggcgaacaggctcgatcacgccggatga

SEQ ID NO: 711 - DNA, 699 bp, Mycobacterium tuberculosis H37Rv
gtgataagcaccacaagaattgatttcctatggatattgtcggtagcgttcgcgtccatgattgctcttgcaacgctgttgacgcttatcaatcaagtcgtcggcactccgtatattcccggtggcgattctcccgccgggaccgactgctcggagctggcttcgtgggtatcgaatgcggcgacggccaggccggttttcggagataggttcaacaccggcaacgaggaagccgccttggcggctcggggctttcaacagggaaccgcccccaatgccttggtgatcggttggaatggccaccacacggcggtgacgctgcccgatggcacgcccgtatccagtggtgaaggcggtggcgtgcgggtcggtggcggtggcgcctaccagcccaaattcacccaccacatgtatctgccgatggatgtggacgcgggagaagaccagccgccggcgccagatgagccggtcaccgcggtcgacgacgtggaaccggaaatgcctgcaccgtgcccgacccagcgcccgccggtgaccccgagacataacctgtgcaacaaactccggactatgccaggggcgctctcggccgcgctggccgcggcggcgccggtctggccggcccctataagcggctgccgcgggttcagcacgtccctcttagcaaaaagaaatcacccagtaatcgtcgggaaatag

SEQ ID NO: 712 - DNA, 375 bp, Mycobacterium tuberculosis H37Rv
atgacgacgatgattactcttcggcgacggttcgcggtggccgtcgccggcgtcgccactgccgccgcgacgaccgtcaccctggctcccgcaccagcaaatgccgccgatgtctatggcgcaattgcctactccggcaacggctcgtggggccgatcgtgggactacccaacccgggcggctgccgaagccaccgccgtcaagtcgtgtggctactccgactgcaaggtgctcaccagtttcaccgcctgcggcgccgtcgccgccaacgatagggcataccagggaggagttggacccaccttggccgccgccatgaaggacgccctgaccaagctcggcggcggctacatcgacacctgggcctgcaactaa

SEQ ID NO: 713 - DNA, 429 bp, Mycobacterium tuberculosis H37Rv
atggccggactgaacatttacgtgaggcgctggcggacagcgcttcacgcaaccgtgtcggcattgatagttgccatcctcggactcgccatcaccccggtcgctagtgcggcgacggccagggcgacgttgtcggtgacatcgacgtggcagaccggtttcatcgcccgcttcaccatcacaaactcgagcacggcgccgctaaccgattggaagcttgaattcgacttgccggcaggagaatccgtcttgcacacatggaatagcaccgttgcacgatctggcacgcactacgttctcagcccagcgaattggaatcgcatcattgcccccggtggttcagccacgggcggcctaagaggcgggctgaccggttcttactcgccgccgtcgagttgtctgctcaacgggcaatatccttgcacctag

SEQ ID NO: 714 - DNA, 1551 bp, Mycobacterium tuberculosis H37Rv
atgctgactcgcgctatcaagacccagctggtgttgttgacggtgttggcggtcatcgcggtggtggtccttggttggtatttcctgcggatacccagcctggtcggcatcggtcgatacacgctttatgccgaattgcctcggtccgggggtctataccgaacagccaacgtcacatatcggggcatcaccatagggaaggtcaccggcgtcgaaccaaccgagcggggcgcgcgagcaaccatgagcatcgacaatggctaccagatccccaccgacgcctcggccaatgtgcactcagtgtcggcggtcggcgagcagttcgttgacctggtgtcgacccgcaccagcggtccgtatctgcggcatgggcagacgatcaccacgactacggtccccagccagattggcccggcgctggacgccgccaaccgtggattggcagtgctgcccaaagaccgggtcgcgtcggtgctgcacgaggcgtcggaggccgtgggcgggctgggatcctcactgaatcgcctcatcgaagccacccaggcaatcgcccacgatgtcaggggcagcctcgaggacatcgacgacatcatcgagcgttcggcgcctatcatcgatagccaggtcaattccggcaacgagatcgcccgctgggccgccaacctcaacacgctggccgctcagaccgcgcagaccgatccggcggtgcgaagcattctggccaacgcggcaccgactgccgatcaggtcaacgccacgttcagcgacgtgcgggagtcgttgccgcagacgctggccaatctcgaggtcgtaatcgatatgctcaagcgctaccacaacggcgtcgagcaggcgttggtgttcttgccgcagtccggcgcgatcgcccagtcggttactacagagttccccggccaggccggactgggtgtcggcggcctggcgctcaaccaaccaccgccgtgcctgaccggcttcctgccggcgtcggagtggcggtcacctgctgacaccagcaccgcaccgctacccaagggcacctactgcaggattccgatggacgcgagcaatgtggttcgtggagcacgcaacaacccgtgtgtagacgtgcccggcaagcgggcggcgaccccgcgggaatgccgcagcaatgaagcttatgtgcccgggggcaccaatccctggtatggggaccccaaccagatgctcagctgtcccgcgccggccgcgcgttgtgaccagccggtgaagccaggccaggtgatcccggcgccgtcagttaacaatggcatcaacccgctgcccgccgatcagctgccaggcacacctccaccggtcaacgatcctttgcagcgacctgggtcaggcaccgtccagtgcaatgggcaacaacccaacccgtgcgtctacaccccgagcacatttcctacaaccatttacgacgtgcagagcggcaaagtcgtagcacccgacggtgtggtgtattccgttgaggcttcgactcatgccggagccgacggatggaaggtgatgctggcaccaaccggctga

SEQ ID NO: 715 - DNA, 480 bp, Rickettsia prowazekii strain Madrid E
atgttaaataatacacaatttttaaatttgatgaaatcctatatgaaaccagaattttatatgagttctataaaaaataccactaatctagatctttcatctatcaccaatacaattcaaaaagccatgaatattttttttaccactaacaaaatttccacagaaagtatgcaatctttgtttaagaaaaattccgagattatacaaaataatattaatactattttaaatagtactaaagaagtaataaattctaaagattttaaacaagctactgaatatcatcaaaaatgtgtaaaatctatttatgaaacatctatggacaatgctaaggaattagcaaatattgcttatgaagcttcaaataaaatatttgaagccgcaaataaacatattaccaagaatattcataatgcttctaataatatacataatactgcagaacaagtacaaaaaaactttaataacaaatctgcttaa

SEQ ID NO: 716 - DNA, 492 bp, Rickettsia prowazekii strain Madrid E
atgaatattaaattagttacatattttttaatattagtaagctcattaaaagtaaatgctgatttaaatcatattcaagatagttttaaatatcaagaagcagagcagttaacaatagaattaccttggaatgactgtactgcaattcataaattcttagaagaaaagttatttttttcagaacaacaaataaaaaaagaaaataaaattcatgagaaatataagcaattttatttacaacataataataagctttctgatttttctatgcaatttctagaaaaaaaatctgaaattaatagtgtcgaaactttaatatcaggctttttaaaattttgtgaagataattttcaaacaagtaaaagtaaatcgcattctttaaattttttccaaaaacaacaagaccaatggttacataatataagaaatgagaattataaaacatattataagaagaaatatgaagacaatacctttagaaatattaattaa

SEQ ID NO: 717 - DNA, 669 bp, Rickettsia prowazekii strain Madrid E
atgaaaaagttacttttaattgctactgcaagtgcaacaattttatcttctagtgtatcgtttgcagagtgcattgataatgaatggtatttaagagcagatgcaggtgtagcaatgtttaataaagaacaagataaggcaacaggtgttaaattaaaatctaataaggctattccaattgatttgggtattggttattatatttctgaaaatgtacgtgctgatttaactttaggaactacaataggtggaaaactcaagaaatacggagcagcaactaatacacattttactggtactaacgtttcagtgagccataagcctactgttacacgtttgcttattaacggttatgtagacttaacaagttttgatatgtttgatgttttcgttggtggtggtgtcggtcctgcattagtgaaagagaaaattagtggggtaagcggtcttgcatctaacactaaaaataaaaccaatgtatcatataagctgattttcggtacttctgcgcaaattgcagatggtgttaaagtagagctagcatatagctggataaatgatggtaaaacaaaaactcataatgtaatgtacaaaggggcaagtgtgcaaaccggtggtatgcgttatcaaagtcataacctgacagtaggtgtaagatttggtatataa

SEQ ID NO: 718 - DNA, 1767 bp, Rickettsia prowazekii strain Madrid E
atgaagaagaatatgagaaagcaaatgcttaaaatcatatcaatcattattatttctcttttattaagcagttgctccgaatctacgcgtgatgaaaatggattacttacagatagtcaaagtactataattcgagattatataatatcgcaaaattctaaaaatcttaaagtgaaccttaaagaaaagtttggttccaatttaaaaggagtaaaattaataggaataaagttaacaaatgaagatttatcgggaatagatttcacttcatgcgaaatattacggactgacttcatgggtagcaacttagaaaaagcaatacttacaaattcggtaattcaagaaagtaattttgcggattcagtaataaaaaatatttcaggctataatgctgattttcaaggttcaatttttaataatataacattacaaaatacaaattttgttcaatcaaatttcagtgatactgcttttaataaaagtactataatcaatgtcaattttgaaaattctaaatttagtaatgtattatggtgtcacagtaatattgacagtagtaattttcaaaaaactcatctaaaaaataatagctttaaaaatactaatgtaatgaattcaatattttatggtgcagatttaggcaaaagtgtaataaataatacaaattttactaataattattttgaatctagtgacctaagtaacactaaattcacatcagtaatcattaaagattctaacttcacacaaagtatttttaattcagtaaatttcaataatatacaaagtaataactcttttttttcatatacttcctttgaagattcaacattacacaatattcaccttactaaatgtgatttacaaaacagcacaattaatagttcagttttcaataattttaaaatcgacaatgctatattaacaaatatgagtctcaacgataatacatttaataatttatcaataaaaaatagtaatactaattttgtaaggattaataaatccaaagggtttaatattactttactcaatactaactatagtaatgctatttttagcaataatgatttaaaagaatttaaagtcattaatactgatttaaacaacagtgaaataataaactcaaatttcactaatggacaatttaataatgtaaatttttctcaatctttaatacaaaacgtaaattttacagacgtgaaaattactttaggcaatttaaatcaagtagctctaataaattccaatctaataaacactaatattattaactcagtcctttctaattcacaaataaataatattaactaccaagcatattatagttttatcaatactaatgtttctaataatattgttataaatgataattcgaatcaaattccaccaaataatatagtaatcaattctgaaaaagatttacaaaacatatctaatttagcaaatatgaatttaacaaattttaacttaagtaatttagtgtttaatggagtagatttttcaaaaagcatctttaaaaaagctaatttaacaaatacagtaataaaaaattctattttaaaagatgctaatttttctgcagcaatacttactaaaacagatttctcaaaatcgatattaacaggtagtatatttaagtttgctcaaattgatcagacatgttttagtaattccgacttaacaaatactgattttactgaagcaacaattaaaaatactgcatttgataatgctaatacacacggtataaaaggattagaataa

SEQ ID NO: 719 - DNA, 3885 bp, Porphyromonas gingivalis W83
gtgatacaaaaatttactaatgtaaaactaaatgatatgcgaaaaattttgagctttttgatgatgtgctctctgcatttaggtctacaatctcagacttggcatggagatccggactcagtggcagccctaccttctatcggtattcaagagtcaagttgtacccgaatcacgttcgaggttgttttccccggattttatagtgtggaaaaacgagaaggcaaccaagtctttcagcgcatttccatgccgggttgtggctcgtttgggaatctgggcgaagctgaattgcctgttttgaaaaagatgatagccgttccggaattttcaacagctaacgttgctgtaaaaatcaaagagacggagacattcgacaattataatatctatcctaatcctacctatgtcgtagaggagttgcctgagggggggacttatctggtagaggctttcgcgataaacaatgactattatagccaaaatgtaagcctcccttctactcactatgtctattctcaagacgggtattttcgctcacaaagatttatcgaagttaccctgtatccttttcgatacaaccctgtccgacaagaaattctatttgcaaaaaaaatcgaggttacaataactttcgataatcctcagccacctttacaaaaaaacaccggcatatttaacaaagtagcctcctctgcatttattaattatgaagctgatggcaaatcggcgatagaaaatgatatggtgttcagtcgtggtacaacaacgtacataagcggaaatgttgccagcaacctccctcagaactgtgactacttggttatttacgatgatatgttcaacgtaaatcaacaaccacacgacgaaatcaaacggctgtgcgaacatagagccttctacaacggctttgatgtagctgctgtaagtataaaggacgtattgaatagcttcccatcaaatgccacctcatacatcaacgaaactaaactgaaaaatttcattcgctcagtttacaaccaaagcaatgcgaagaggactttagatggcaaactgggatacgtgctactgatcggaaaaccattgagcaaatatttggctgacactgataatacaaaagtcccaacctcttttattcataatgtctccttaattccaagtcatccaacttttggttccatatgcgcctccgactatttttttagttgtgtttcgccccttgatactgtcggcgatttgtttatcggtcgatttagcgtcaccaatgctcatgaattgcacaatctgattgaaaagactatcaacaaagaaatctcatataatcctattgcacacaaaaatattctttacgcagaagggaaaggctgcgatgctccaatcttacgtttattcttaaaagaaatcgcctctggttacacagtcaactctatcttaaaatctaatcaggtctctgcaatagactcgatatttgactgcttgaataatggttcccatcatttttattttaacactcatggaatgccgactgtttgggggatagggcagggactcgacgtcaatactctaacagcccgattgaacaatacatcttcgcagggattatgtacgagtctatcatgtagttcggctgtagcagattcaactattagatcgcttggagaagtcctgaccacatacgcacctaacaagggattctcggctttcttaggaggaagcagagccacccaatatgccgtttatttagaaggcccctgtcctccgtcagaattttatgaatatttaccttattctttatatcacaatctctcgactgttgttggcgaaatgttgctatcatccattatcaatactaattctgttgatacgtattcgaaattcaacttcaatttgcttggcgaccctgcactaaacattatggctcatggcatggaggttagtaattgtattacactaccaaacaacaccattataagcagtccgataacaataaaaaatggtggctgcctaaaaataccggaaaaaggagttttgcattttactaataatggctccatacaagtcatgtccggaggaactctggaaataggcaatcaggctaaaatatccggagagaccggtgctaaccccacctttattaccgtttacggcgatggtcttgcgattaacaagcaggtagagatagacaatatagaccgacttaacttgttttctacgcattcggtcatgcccaaatttcattttgacagtgtgaaattcaacagtgccccgctgtatacaacgaactgtattgtggagataagcaattgcgaatttaccaatcgaagtgacattatttcaaagaattgtgacctaagcgttgaaaacagtatgtttagcagttcggggataacggtattcaagcctatggctacaagctccatcaccggattatctacaaaagcaaagattaccgacaatactttttttgcgacaggaaacttcgcctaccatatcacaaacacgccaggcttaacagcaacctccaatgctgccatcaagttagacaatattcctgagtattacatttccggtaataaaatagtcaattgcgatgaggctcttgtactaaataatagtggcaacagaacgaacagactccacaatatcacacggaatgtgataaaaaactgtaggattgggagcacgctttataattcctatggtatttacaaccgaaataagatcagtaacaatcatataggagtacgtctcctcaacaacagttgtttttatttcgataatgctcctgtaatcaatgaagaagataagcagacgtttatttctaataggacttggcagctctattcatcaaacggtacattccctctcaacttccattacaacagcttgcaggggggagatacagatacatggatttacaacgacacgtatacgaatcgctatattgacgtttcaaataatcactggggcaacaatgatttgtttgatccgaatcaggttttcaatacgccagacttgttcatttggatacctttttgggatggattgccaaatgggagatcgggcaatagctctgctgaagcagtagaattccaaacagcattggactgtattggcaatagcgattatctttcggcaaaagtggctctcaagatgatggttgaaacctacccggaatccgactttgcaatagctgctttgaaggaattgttcaggatagagaaaatgtcaggcaacgattacgaaggcttgaaagattatttcagatccaatccaaccatcatctcttcccagaacttgttcccgacagctgatttcctgtctgcgcgatgcgatattgtgtgtgaaaactatcagtctgccatcgattggtacgaaaatcgcttgaatagtgaaatctcctatcaggacagtgtttttgcagtcattgaccttggtgacatttattggaatatgcagttagactcactcagagggactggtatagatttgaacatactttcctgtgaacaaaggaaatcgctcgaaagccatcaaaatgtaaaaaattatttgttgtcaactcttcccgaatcaacaggtactctcctgcctccattagaatgcaacaaatcaagccttgataaatccaagataatctctatttcgcccaatccggcgaaagctgttgtaacaataatctactataccgataacccttcctgttctgtaataaaaatatatggaataaatggagcctcggctgatataaccgggttgcccaaacatctatccgaaggttattacagcatacagttcaatacatccaactttgatcccggtttctacctggtaacgctaaatgttgatcagaaaattatagatacggaaaaattacgaatcaaataa

SEQ ID NO: 720 - DNA, 2322 bp, Shigella flexneri 2a str. 2457T
ttgcagggtaaaaacacgattgtcacaacgggggattactcaattggtttgctaagtcaaacgagtggaaacctgaatactgacaccataataagagtcaactctgacggttcggttaccccctctttttctgacggagatgatacatttattgttactgcgggtaatcacgcagtcggcgttcttgcgtgtgcatctcccggaagcgcgtgtgcgtgtgtatcttctcttgatgaagaaagtactgccgatacaggaagtaatgaaaataatgccatagcaaaactggatatggcaaaaggggagatcacaacccacggaacagaaagttatgccgcgtacgctaatggcactgtcgtcaaggctggtgacacgcttgattataccaatgccagcgttacattaaccgatgttgatatcaccacgcatggggacaatgctcatgccatcgctgcccgccaggggacagtttcatttaaccagggagaaatttatacaacgggtcctgacgccgcgattgctaaaatttataatggcggcacggtgacgctgaaaaatacatctgcagtcgcgcatcaggggtctggaattgtgctggagtcttccataaatggtcaggaagcaacggtagatattttatctggtagctcactacggtcagcaaatgaaatcctctaccataaagatgagacgagtaacgtgaccattacggatagtgaggtatcatcggctgcagatgtttttatcaataatattaaaggtcatttgaccgtcgatgcaactaattcaaaaataacgggttcagctaatatttcaacagatgataacactcatacctatctgtcgctttcagataatagtacctgggatattaaagctgactcaacggtgagcaacctcacggttgataatagtacggtctatatttcccgggcagatggacgggatgtcgaaccaacaagattaacaataactgaaaattacgttggtaataatggcgtattgcatctcagaactgaattggatgatgataattcagctacggataaagtcgttattaatggaaatacctctggaacaacccgagttaaagttaccaatgcaggaggcagcggagcttacacgttaaatgggatagagattatcagcgttgagggggaatcaaatggggaatttattaaggattcgaggattttcgccggtgcctacgaatattcattaacccgaggtaataccgaagcgaccaataaaaactggtatctgactaacttccaggcaacgagcggcggtgaaacaaactccggaggaagttcagcgcctactgttgcgcctacccccgtcctgcgccccgaagctggaagttacgtcgccaacctggcagccgctaacactctttttgttatgcgtctgaacgaccgtgcgggtgaaacgcgctacatcgatcctgtaactgaacaggagcgttcaagccgactttggctacgtcaaattggcgggcataatgcctggcgtgacagcaacggacagttgagaacgacctcgcatcgctacgtctcgcagttagggggcgatctgttaaccggtggttttaccgatagtgacagttggcgtttgggagtgatggctggttatgcccgcgactacaacttaactcattccagcgtgtcggattatcgttcgaaagggagtgtcagaggctatagcgcagggctgtatgccacttggtttgccgatgacatcagtaaaaaaggcgcatacattgactcctgggcgcaatatagctggtttaaaaactccgtgaaaggggatgaattagcctatgaatcctatagcgcgaaaggtgcaaccgtctcgctggaagcgggttacggttttgccctgaataaatcctttggtctggaagcggcgaaatatacgtggatcttccagccacaggcacaggctatctggatgggcgtcgatcataatgcgcacacggaagccaatggctcacgtattgagaatgacgcaaataacaacatccagacccgactcggcttccgcacctttattcgtactcaggagaaaaacagcggtccgcacggtgacgactttgaaccttttgttgaaatgaactggatccataacagtaaagattttgctgtctcaatgaacggtgtgaaagtcgaacaagatggggtgagtaatttgggggaaattaaacttggcgtaaatggcaacctgaatccagcggccagcgtctgggggaatgtgggcgtgcagctgggtgataatggctacaatgacaccgcagtgatggtgggcctgaaatataagttctga

SEQ ID NO: 721 - DNA, 747 bp, Shigella flexneri 2a str. 2457T
gtgaccaaactcaaacttctggcacttggagtgcttatcgcaacgtctgcaggcgtagcgcacgctgaaggtaaattttccctgggcgcaggcgtaggtgtcgttgagcacccatataaagattacgataccgatgtttacccagtaccggtaatcaactatgaaggcgataacttctggttccgtggcttaggtggtggttactacctgtggaatgacgcaacggataaactttcaattaccgcttactggtcgccgctttacttcaaagcgaaagacagtggcgatcaccaaatgcgtcacctggatgaccgtaagagcaccatgatggctggtctgtcttatgctcactttacccagtacggttacctgcgtaccaccctggctggcgataccctggataacagcaacggcattgtctgggatatggcctggttgtatcgttacaccaacggtggcctgaccgtgactccgggtattggtgtgcagtggaacagcgaaaaccagaacgaatactattatggcgtatcgcgcaaagagtccgctcgcagcggtctgcgtggctataacccgaatgacagctggagcccttaccttgagctgagcgccagctacaacttcctcggcgactggagtgtttacggtaccgcgcgctacacccgtctgtctgatgaagttactgacagcccgatggtggataaatcctggactggcctgatttctaccgggatcacctacaaattctga

SEQ ID NO: 722 - DNA, 543 bp, Shigella flexneri 2a str. 2457T
atgaaaaaaattgcgctagcaggtctggccggaatgctgttggtttctgcatcggtcaatgcaatgagcatcagcggccaggcgggtaaagaatacaccaatattggtgtcggttttgggactgaatcgacgggcctggctttaagcggtaactggacacataacgacgacgacggtgacgtcgcgggcgtggggctggggttgaatctgcctctcgggccgttaatggcgaccgttggcggaaaaggcgtgtacaccaacccgaattacggcgatgaaggttatgccgcagcggtaggaggtggtttgcagtggaaaattggcaacagcttccgtttgtttggcgagtattactactctccggattcgctctccagcggtattcaaagttatgaggaagcgaatgctggcgcgcgttacaccattatgcgtccagtcagtattgaggcgggttatcgctacctgaatctgtcgggtaaagacggtaaccgcgacaacgctgtggctgacggcctgtatgttggggttaacgccagtttctga

SEQ ID NO: 723 - DNA, 1215 bp, Shigella flexneri 2a str. 2457T
atgactaccttgaccgccagggtgtttacaacggcagagataatttatcggaaaacagttatcgcattggtgtgtcatttaaactgtagtagacaggagacagtcacaatgaataaaactataatggcgcttgctatcatgatggcttcatttgccgcaaacgcgtctgtattaccggaaactcctgtgccatttaaaagtggtaccggagcaattgataacgacactgtctacattggtttaggtagcgcaggtacagcatggtacaagctagatacacaggccaaagataaaaaatggactgcgttagctgcattccctggtggaccgagagagcaagcaacctctgcatttattgatggcaatctgtatgtgtttggcggcattggcaaaaacagcgagggattgactcaggtatttaatgacgtacacaaatacaaccccaaaaccaatagctgggttaaattgatgtcgcacgcgccgatgggcatggcgggtcatgtgacttttgtacacaacggcaaggcttatgttactggcggtgttaaccagaatatcttcaatggctattttgaagatctcaacgaggctggaaaagattcaaccgctatagataaaatcaacgcccactattttgacaaaaaagcagaagattatttcttcaataagtttctgttgtcttttgatccctcaacacagcaatggagttacgctggcgaatcgccctggtacggaacggctggtgcggcggttgtgaataaaggtgataaaacctggcttattaatggcgaagccaaaccaggattgcgaacggatgccgtatttgaacttgatttcaccggtaataatttaaaatggaataagcttgatcccgtctcatcaccagatggcgtcgctggcggttttgcggggataagcaatgattctcttatatttgctggaggggccggattcaaaggttcacgagaaaattaccagaacggtaagaactatgcgcatgaaggcctgaaaaaatcatatagcactgatattcatctttggcataacgggaaatgggataaatcgggtgaattatcgcaaggtcgggcctacggagtatcattgccctggaataatagtttattaattattggcggtgaaactgcaggcggcaaagcggtgacggattcagttttaatttctgtgaaggataataaagtcacagtacaaaactaa

SEQ ID NO: 724 - DNA, 489 bp, Shigella flexneri 2a str. 2457T
atggcaactggcggcgctgccctggcaggtaaagcggttatgggtgccgcagccggtgcagccggaggtgcaagtgcactccaagcggcttttcagaaagcatcagcgagtatggaaaccggcggtgacatgtccagcatggggtcagttgtcagcagtggcggaaacggtggtggtgaagcgggtactgctggcagtagcccattcgcccaagcggctggctttggtgacagcggcagtagctcaagcggtggcggctttgccaaggccgcgaagctggccacaggcacggcctccgagttagccaagggtgtcggctctcaagtgaagcagggattccaggagcgagtgagcgaaaccacaggcggaaaactggctgcttcgatacgcgaaagcatggagccgaaagaagcaagccaatctggccagttcgagggcaatagcttgggcgccgattctggcccagatagtaacgaagtcaggagttag

SEQ ID NO: 725 - DNA, 2361 bp, Shigella flexneri 2a str. 2457T
atgaagcgagttcttattcctggcgtcattttatgtggcgctgatgtggcgcaggccgtcgatgacaaaaacatgtacatgtatttttttgaagagatgacggtctatgctcctgtccctgtacccgtaaacggcaacacgcattacaccagtgaaagcatcgagcgtttaccgaccgggaatggcaatatcagcgatctgctgagaaccaaccctgcggtacgcatggattcaacgcaaagtacctcgttgaaccagggagatattcgccctgagaaaatctctattcacggtgcgtcgccctaccagaatgcctatttgattgacggtattagtgcaactaataacctgaacccagcgaatgagtccgatgccagtagtgcaaccaatattagcgggatgtcacaggggtattatcttgatgtcagcttactggacaatgtgacgctttatgacagttttgtgccggttgaatttggtcgcttcaatggcggggtaattgatgcaaagatcaaacgcttcaacgctgatgatagcaaggtgaaattgggttatcgcactacgcgtttggactggttaacatcgcatatcgatgagaataacaagagcgcatttaatcaaggttcttcaggaagtacctatttctctccagattttaaaaagaacttttataccttgtcgtttaatcaggagctggctgataactttggcgttaccgccggtttatcgcgccgccagtctgatatcacccgcgcggattatgtttcgaatgacggcattgtcgccggtcgggcacagtataaaaacgttatcgatactgcattgagcaaatttacctggtttgccagcgaccgctttacccacgatttaaccttaaaatataccggctccagccgtgattataataccagcaccttcccgcagtctgatcgcgaaatgggtaataaatcctatggtctggcatgggatatggatacgcaactcgcatgggccaaactacgtaccaccgttggttgggatcatattagtgattatacccgtcacgatcatgacatctggtacaccgaactttcatgtacatatggtgatattacagggcgttgtacccgtggcggattaggacacatttcccaggctgtagataattacaccttcaaaacacgcctggactggcaaaaattcgccgtgggtgatgtttcgcatcaaccctacttcggcgcggaatacatctattccgatgcatggactgaacgccataaccagtctgaatcctatgtgattaatgctgcaggaaagaaaactaaccataccatttaccataaaggtaaaggcagcctgggaattgacaactacacgctgtatatggcggatcacattagctggcggaatgtgtcgttaatgcccggtgtgcgttatgactatgacaactatctgtcaaaccacaatatctccccgcgctttatgacggaatgggatatttttgctgatcaaacctcaatgattaccgccggttataaccgttactatggcgggaatattcttgatatgggattacgtgatatccgcaatagctggacggaatcggtatcaggtaataaaaccctgacgcgttatcagaatttgaaaacgccttataacgatgaactggcaatgggattgcagcaaaaaatcgataagaacgttattgcacgcgcaagtgaagcgcatgatcaaatcagcaaaagcagtcgtaccgacagcgcgactaaaaccaccattactgaatataacaacgatggcaaaaccaaaacgcattcgtttaacctcagttttgaactggccgaacccctgcatatccgccaggtagatattaacccgcaaattgtctttagctatatcaagagcaagggcaacttgtcgttaaacaatggttatgaggagagcaataccggtgataaccaggtggtttataacggtaatctggtctcttacgatagcgttccagtggcagattttaataacccattaaagatctccttaaacatggatttcacgcatcaaccgagcgggttagtgtgggcgaatacgctggcctggcaagaagcgcgtaaagctcgcattatccttggtaagacaaatgcgcaatacatcagcgaatattcagattacaagcagtatgttgacgaaaaactggatagcagcctgacctgggacacccgcttgtcctggacgccacaatttctgaaacaacaaaacctgacgatcagtgccgatattctcaatgtactggatagcaaaaccgctgttgatacaacgaacaccggtgtggcgacctacgccagtggccgtactttctggcttgatgtcagcatgaaattttaa

SEQ ID NO: 726 - DNA, 513 bp, Shigella flexneri 2a str. 2457T
atgaagaaaacattgttagcaatcatgctggcggggacagcttttgcttctcaggcgggaactttagtaagccagggtactgaagcgtcagctaatcttactttgaccaagcctatcgttgttaataataccattcaaccagtgaaaggggtatatagcggtacgttaactgcatggacgcctttggcaacaggtattgttggcgcatctgatgggcagagccacgactatgctgtaactttcccggatgatatttatgcggagagcagtacttcagcggatgcagtaatttctggtgacaataacccggaccataaactgaaagtttccctgacaacgcttgagcaggatcctccttcagctgcctccgaagagattggcggtaagcgttatatgatgctgaaaaatactggaacaggtggtgcctatcgcgtcgtttcccatatgaaagaacaggttgttgagccagactcttacaccatccgtacccaggcttatatctacgcagaataa

SEQ ID NO: 727 - DNA, 705 bp, Shigella flexneri 2a str. 2457T
atgggtatttaccactggtcccggaagacaaaaatgaaacggacaaaatccatacgccacgcatcgttccgcaaaaactggagcgcacgccatctgacaccagtcgctctcgcggttgccactgtttttatgctggctggctgtgaaaagagtgatgaaacagtgtctctctatcaaaatgctgacgactgttcagctgcaaacccaggcaaaagcgccgaatgtaccaccgcgtacaacaatgcgctgaaagaagccgaacgtactgcgccgaaatacgccacccgtgaagactgtgttgctgaatttggtgaaggtcagtgtcagcaagcaccagcccaggctggcatggcaccagaaaaccaggcgcaggctcagcaatccagcgggagtttctggatgccgctgatggccggttacatgatggggcgtctgatgggcggcggcgcgggatttgcacagcagccgctgttctcctcgaaaaacccggccagtccggcttacggtaaatataccgacgcgacgggtaaaaactatggcgcagcccagccaggccgcaccatgaccgtaccgaagacggcaatggcaccaaaaccggcgaccaccactaccgttacccgtggcggttttggtgaatctgttgccaaacaaagcactatgcagcgtagcgcaaccggcacctcttctcgttcaatgggtggctga

SEQ ID NO: 728 - DNA, 642 bp, Shigella flexneri 2a str. 2457T
atgacaaaaatgagtcgctacgccttgattaccgcgctggcgatgtttctcgccgggtgtgtggggcaacgtgaacctgcaccggtagaagaagtgaaaccagcgccggaacaaccagccgagccacaacagcctgtccccacagtgccctcggtgccgacgatcccgcagcagccaggcccaattgagcacgaagatcgaacggcaccgcctgcgccgcatattcgccattatgactggaatggcgcaatgcagccgatggtcagtaagatgcttggggctgacggggtgactgcgggtagcgtcctgctggttgatagcgttaacaaccgtactaacggttcgctgaatgccgcagaagcgaccgaaacgctgcgaaatgcgctggctaataacgggaaatttaccctggtttccgcccagcaactgtcgatggctaagcaacagttaggtttgtcgccgcaggacagtttaggcacccgtagtaaagccataggcattgcccgcaatgtcggcgctcattacgtgctgtactcctgcgcctctggcaacgttaacgctccgaccctacaaatgcagctgatgctggtgcagacgggcgaaattatctggtcaggtaaaggtgccgtttcgcagcaataa

SEQ ID NO: 729 - DNA, 516 bp, Shigella flexneri 2a str. 2457T
atgacgaaacttatgcaatttgttcagaggtgctattatatgactaataagaaaatgtattttatattaatacttgttttcacattgctacaggtgtgtttttttgctctctggaaggctcgtgatggtagcacaacgtctcttgaatgtacgtcgacgttaacaagaaatgctaaaacagatcattctttatactactctgctaacctttcagtcattttaaaaaaagatggtagcggtagttttacgattgttggcttaactgatgaagatacaccgaggaaattttcccattcgtatttttttacctacaaaatagatagtaacggacggatctcaggtaatgctaaggccaaagtttcgggactggaaaatcagataaaggatgagaacttcagactcaattttctcgatgcatctttaacaggtaaaggcaatgcgaggctaagcaagtttaataatgtctatatttttagtatcccggggttgatcattaacacatgtgctccaatataa

SEQ ID NO: 730 - DNA, 474 bp, Shigella flexneri 2a str. 2457T
atgggcaggataagctcgggaggaatgatgtttaaggcaataacgacagtcgccgcactggtcatcgccaccagtgcaatggcgcaggatgatttaaccattagcagccttgcaaagggcgaaaccaccaaagctgcgtttaatcagatggtgcaagggcataagctacctgcatgggtgatgaaaggcggtacttatactcccgcacaaaccgtaacgttgggagatgagacgtatcaggtgatgagcgcgtgcaaaccgcatgactgtggctcgcaacgtatcgctgtgatgtggtccgagaaatctaatcagatgacggggctgttctcggctattgatgagaaaacgtcgcaagagaaactcacctggctgaatgtgaacgatgcgctttcgattgatggtaaaacggtgctgttcgcggcgttgaccggcagcctggaaaaccatccggatggctttaattttaaataa

SEQ ID NO: 731 - DNA, 636 bp, Streptococcus mutans UA159
atgaaaaaacaatttttggaaaaagctgtgtttactgttgcggctacggcagcaacagttgttttaggaaataaaatggctgatgcagacacttatactcttcaagaaggagattcttttttcagtgttgctcaacgatatcatatggatgcttatgagttagcttctatgaatggaaaagatattaccagtctgattttgccgggtcagactttaactgttaatggttcggcagcaccggataatcaggcggcagcgccaactgacactacgcaagcaaccactgaaacgaatgatgcgaatgccaatacttatcctgttggtcaatgtacttggggggttaaagctgttgcaacttgggcaggcgactggtggggcaatggcggtgattgggcctctagtgcttctgcacaaggttacactgtcggtaacactccggcagtagggtctattatgtgttggacagatggtggttatggacatgttgcctatgtcacagctgttggtgaagatggtaaagttcaagtactggaatccaattataaagatcaacaatgggttgataactatcgtggttggtttgatccaaataatagtggaacaccaggcagtgtcagttatatttatcctaactaa

SEQ ID NO: 732 - DNA, 867 bp, Streptococcus mutans UA159
atgtctattaaaaatattttagaaaacaaaacaacaacaattaaagttagttttgcaggaattgcaacagcagctagtttaattttacctatggcagtacaggcagaaactacttatactgtgaaatcaggagatactttatcagagattgcttcaacacacggaacaactgttgataaacttgctaagttaaataaaattaataatatccatcttatccatgctggtcaaattttagaattagatgcagcaacagaagatactgatgcaacgccagtacaagaaagtcagataaatgaagcagaaacctcagcatctgccaaaactagtcaaacgagcgaagtgacgacaacagcaccggtacaagaaagccaaacaagtgaagttataacttcagcaccagctgaaaccagtcagacaagcgaagtgccaactgaagccaaccaaacaaatgaagtaagttcagcagtatcggttgaaaccagtcaaacgagtgaggcgacgacttcagctccagtggaaactagtcagacaagcgaagcaacgacagcggaaccaactgagaccaagaccagccaaacaaatgaagtagcagcttcagctgaagaaaaccaaacaacatctaatactagcggtttgagcacatctgatgcagctgcaaaagaattcatcgctcaaaaagaatcaggtggtaattataatgctaaaaatggtcaatattatggacgttatcaattgagtgattcttacttgaatggtgatttgtcagaagaaaatcaagaacgtgtagcagatgcttatgtatcaagtcgttatggttcatggactgctgctcaagctttctggaatgctaatggttggtattaa

SEQ ID NO: 733 - DNA, 354 bp, Streptococcus mutans UA159
atgaaatgtcaagcgtttgaagattttaaagctacaagtttgaataagctgtcttatacgacaggtggagctactgatggtgaaattatagctaatcggatgttacaaggtaaagctactaagggcgaaattactatgtatacttggaacattattcaaaatggctgggtgaattcactcgtgtcttggggtattggtggttataatagttctataggatactcagctcaaggtaatagaggatttagtaattatccatacgatgtttctatggattcagataatagcagtagttcaagtaatacgacaggtggttatgttaattataaccagagttttaattctggatggtaa

SEQ ID NO: 734 - DNA, 1557 bp, Streptococcus mutans UA159
atgcgctattcacaaatttgtcgtaaaagtttggctttgctggctacaggaatgattttaactacctcaaccttacctagtataagtattctagctgaggacagtactggagcacctgctaggccagatggacaagctcctgctggaggtggtgctaacaccacaacttatgattacagcggaatcaacagtggtgttctagttgctaatggtagcaaggtcacttccagttccaaaaccaaatcaactacttccgcccaaaatacagctcttgttcaaaacggtggtagtttaacactgcataaagcgaatttaataaaatccggtgatgataacaatggtgacaatgataatttttacggtattaattctattttactagcagtcaatgaaaggtcaaaagcttatgtttcgaattccaaactaaaagctagtagctctggcagtaatgggatttttgcaactgataaggcaaccatctacgctaataaaacaagcattgcgactacagctgataattcacggggacttgatgccacttacaatggcaatattattgctaataagatggccatttctacaaaaggtgctcacagcgctgctattgcaactgaccgtggtggcggcaatatttccaccactaattccagtttaaatactagtggctctggctcacctcttctttattcaacaggcaatattcaagttaatcacgttacaggaacatctagtaacagccaaattgctggtatggaaggtcttaataccattcttattcataattctaatttaattagtaccatgacaaacaaaactgccagtgacccgattgccaatggcgttatcatctatcagtcacaatccggtgatgccgaagcaacaacggggcaaagtgcccacttcgagctcagcaagtctaaattaacttcttccattacttcaggttctatgttctacctgacgaatacctctgcaaacattatccttaatcaatccaccttgaattttgatgcaaataaggctaaacttttgactgtagcaggcaatagtgccaataattggggaacccccggtagtaatggggcaacagttaactttactggccataagcagacacttaaaggggatgttgatgtggatagtatttcgaccttaaatatgtacctgcttgataaaaccaactacactggcaaaactgctgtatcaaccaacagtaccaatatatccccaagcacgtctcctattaccatgaatatttctaaaaattccaaatgggtgctaactggtcattcgacagtaaccaatctcaatgctgaaaaaggtgctaaaattgttgataaagacggaaaaaccgtcagcgtcatctcttcaagcggacaaaaacttgttaaaggtaaaagcaaatatagcctaacagtcacaggaacttacagtcaaaaggtaacaaccagctcaagtaacaaacccagcagcagttacattaaccgtagtgacttcgataattattttaaaacaacaacagcctttgtaaataataccaaaaatacaagtaattaa

SEQ ID NO: 735 - DNA, 978 bp, Streptococcus mutans UA159
atgaacaagataggtgatactctacgtgatgctcgtattgaaaaaaaattgagttttgatgatgttgtagataaaactggaattgctcctcactatatactggcaatggagttagatcaacttaaattattaccagaaggcaaaacaaatgagtatttagaaaaatatgctcatgctgttggcttagatccggtttctattattcatggttatcgcaatcaggaaatgagcgatgaacttatcctaccttcttctgcagaattggctgcttcttcagatagcaatatagaaaagaaaaatgaaggaaaatcaattgaagaacctcaagagttagctattgatagtttggatgttactcaaaatattacagaagagactccccaaatagaagattttaaggttgaatcagaggaggcaagtaaaaaaatagaaaaaataccatctcgacttagtaaatatgattatgatgaagaaccgaaaaagaaatttccatgggctttaattctgctaattttacttgctttaactattatcagttatgttggatatgtggtttataatcagctgcaaactgattcaaataagactgaattaagtacctctacgaaaaaatctaaggatactaaaaatgatgccaattcaacgacacaaagtcagaccagcataacaacagactttgctgatggtggaaataatatcaccttaagtaatactaatggaaaagtagaggttacctttactttgacaggggatgaggaaagttgggtttcagcaactaacactactgatggagaatctggaacaactctaacagcaacagataaaacttatactgttactttagcagaaggttcaacaacatctatgctgacagtcggatcacctagcggtgttgaaattacgatcaatggtcaaaaggtggatactacaaaccttgttaatgctggtttgactaatattaatttgacagtccaataa

SEQ ID NO: 736 - DNA, 1521 bp, Streptococcus mutans UA159
atgaagagcagaaaacgtcagcgaaaagggctggttcgaaaaaatgaaatcattattttaactctttttgtcgcatcagccgtttcactcttagcatttaccaattcttttggggtacttgctaagagtcttcatcttgaaaaaatcaataaatcgataactatttcgcttccttttggtaaaaaaaagatggaacaaacagcacgttactattcaggtgaacaggttcagatcagttcctcagctaaaaaagacagtcttggaaaagggctgtctcattaccaaaattggattgggacagttaaaaagataaaatcacaaaaagacagtcgtcaaaagcatcattatagttatgaagttacatttgataatggcaaagctttgaaatatgttcaggaaaaagacttagttaaaacaaaaagatctaaatacagcaaaggtcaaattgtcaaattaaaatcctctgcgacagctgatttagatggcagcagtttaacggattatcgtgcatcagctggtaaaatcgatcatatttcttataatcatagcaataccacaggtggctataagtatgatatcacctttgatgaaggcggcaaggtgactaatattcaagaaaaagatttggataaggtttatgaagttcagctaaaatcagaaaatactgcagctcaaaataatgagattcttaaacaagcttttgcatatgctaaacaacattctggtactatcttaagtttgccaaacggtgaatttaagattggcagtcagacaccagacaaggattatatcactttaacatctgatactgaaattcgtggagataatacgacacttttggttgaaggatcggcttattggtttgcttttgcaactgggacatcagctagtgatggtgtaaagaatttcaccatgcgcaatatcaatataaaagccagtgatttggaaaaaggaaatcagtttatgattatggctgatcatggtgataattggaaaatttgtaacaatagttttaccatggtgcataaaaaaggaagccacatttttgacttaggttccttgcaaaattcagcttttgaaggaaatcaatttactggctatgcccctgaattaactaatgtcagtaagattgatgataatgcagatcttcatgatttttattcagaagttatccagctggatgccgctgagtctagcggtgtttgggatggtgggttgataaaggctattgatccaaattatgaaaattataataaagagaaacagttgtgcaataacatcacgattgctaataactcttttgttccttatatagacagtcatggtaaaataatagcatacagcggaactatcggacagcactcttctgatgtcggccttgtcaaaatttatgataatgtttttagtaactctttggtcagccgtttcaatcaaaatggcaaaagcgaggcgtggatttttaaagctattcacctaaaatcaaattataataatgctgtttatgccaattctatcagttaa

SEQ ID NO: 737 - DNA, 1635 bp, Streptococcus mutans UA159
atgagaaaacttaaagtggcactttttgcaagcagtattttaggaatgctggctgttagttcttatacggcagcagatacagaggataatcaggtaacgattagccattataatgaacaggctggaacttttgatgtcaacgctgtacaggcagccaacggaaaaactattcaatcgatagatgttgcgatttggtctgaagaaaatgggcaggatgatttgaaatggtatcatgccagtaatgatggcagcaatcaattgacagttcattttaatgctgagaatcatggcagtaaggtaggttcttatattgcgcatgcttatattacctatacagatggtaatcgagtcggggttaatttgggaaaacgaaaattatccttatctgcaccgcaattatccttaaaacaaggtggccttcaactattttctaagctgaaacctagtgcagcggatcaacttttttcagcagtttggtcggatgagaatggtcaagatgatcttcattggtacacggcagatgctgacgggaatactttggctggctatgctaatcataaaggttatggaacttaccatgttcatacttaccttaagcaaaatggtaagatgataccaattagtgctcaagatattgatattcctaaaccgaaagtcaagattcagattgataaaataaatgataccagttatgatgttgttgttaataatgtccccccttatattagttcagtagccattcctgtgtggagtgaacaaaatggccaagacgatttgaaatggtatcaggcaacaaaagtggctgatggtatatttaaaacaactgtttatttaaagacacatcgttttgaattaggcaactatcaagctcatatttatggcgatagccaattaagcaagaaactggatggtttaggagaaactcattttaatgttccgtctattattaactatgaagatcctcaggtaactattgatcattataatattaacaaaggaacgtttgatgtgactgtagctgaaacagataattcaaaagcgatacaatcaatcagtgctgctgtttggtctgatgctaaccaagctaatctttattggtatgaagctaaacagctagcaaatggaaaggctgcaattactgtcgatgttcaaaagcatggcaatcaaacaggaagctacaatgtccatgtttatgttcattataatgatggcacgactagcggacatgttttggctaatcagcagctcaatcaaattgtccattatcaaccttctgcagtaagaataacagcctatatgaatgaaaaaaatacttatccagttggtcagtgtacttggggagtgaaagaattagctccttggatacctaattggcttggcaatggcgggcagtgggcaagtactgtagctgttaagggattcaaaataggaactgttcctaaagttggtgctattgcttgttggagtgatggtggttatggccatgttgcttacgttacccacgttgagagtaataaccgtattcaagtgaaagaagctaattataagaatcaacaatatatttccaattttcgcggatggtttgatcccacgacttcctatttgggaagattaacttatatttatcctgactaa

SEQ ID NO: 738 - DNA, 447 bp, Streptococcus mutans UA159
atggcaaataactattctcgtcgtcaacaacccactaaaaaaacaaaggggacaagtcggaaacgtccgactgaacatatcaaaacaggtttttcagcactgcaaaagagtgttgctattatcgctggtattttagggattattaccgctttgattactattaataattatcgcaatagttcacacaatgataaaaaagattccacatctaaaaccactatcatcaaagaaaaagaagtggatgactcaaatagtaacaacaatgctgctaattctcaagctgaaaatgacagcaataacaataataattctgcagaatcaaatcaaaaccaaactgcaacaacagcaaatgacagtaacagcaattcggctaatcaaaatcaagccaatagccaatcacaagcaaataatcagcaaaatcaaaacaatgctaatgctggtcaataa

SEQ ID NO: 739 - DNA, 321 bp, Streptococcus mutans UA159
ttgaaaatatttagttttggaaccattcgaaacaacacagctctaaaacctaactatgatgacacaacagcttttagcggttttggaaccattcgaaacaacacagctctaaaacagagcactaactgcgctagctggttcaatcgttttggaaccattcgaaacaacacagctctaaaactcaccatattaattaatggcgtttccttttgttttggaaccattcgaaacaacacagctctaaaacctcgtggaccaatttttgtctcgacatttcgtaatcgcgccattcatctcagccagatttcagcttcaaaatga

SEQ ID NO: 740 - DNA, 588 bp, Streptococcus mutans UA159
atgaaaagaaaacgaaatctttactttcttattggtttatttttgacagtctttcttttgataggatgctcaatgcagaaaaaaaccaaatcagaaagcagctcgacttctcaaaagactactttacaaacaaaacagtcaagtgaaaaatcaactgatgctaagcaaacgacagaagctcattcagaaagcagtcagtcttcttctcattctaataacgaggaaacccttgctcccattgatacaggcgctgttttaaaggctgattacagtagtatggcaggaacttggaaaaatgaagaaggacaaacgttgacatttgatcagcgaggtctgacaacccctggaatgacagtcagtctgttgaacattgatcaagacggaaatcttttgttaaatgttgagactggaacaaaaaagaatctaactctttatattgtgccagccaataaaaccttatctaatcaatatttttctaatggtcaaagcgatgaatccgataaaacaaaagatcgtattgtttcttctgagagtttaaatagtggcaaatttacaaaccgagtttattatcatgtttcaactcattaa

SEQ ID NO: 741 - DNA, 636 bp, Streptococcus mutans UA159
atgacacctaaaaaaatcaaaatagctctaacagctcttatctctttgatgctcgccttatttttattcttgtttaatcaccattcagtaagagaaaacagtcagcaagaaaagttaaagataagtaaagcaagttctaaaaaatcacaaacaagcacttcttctgttatgacaagtagtcgaaaagctactgaacaaacaagccaagcacagactcaaagtcaatcacaagcagaacaaagtaaccctaatgtgatcctccccattccgcaagaattagtcggcacctacaaaggttcgagtccacaagcatctgaaataacttttaccatttcttcaaatggtcaattacgtgctcaagctaattttgatcctgcttctgatataaatgacgttaccgccactgttagtggtgttagaaaagtcggggcagatacctatatttgggagtttgtctctggtagttcagctgctcttttaccgggtgttacaggtataggagggcttggaaagatgcagcctggtttcatcctaaaaggggggcaattaacacctatcatgtttacaggttctgtagatggtgaaattgattattcacatcccaatccctatccagtatcattaaacaagcagtaa

SEQ ID NO: 742 - DNA, 390 bp, Streptococcus mutans UA159
atgaaaaaaataattaatgttatcgtcttatcactatccgtttttttcctgatagcttgcagcaatagcagtaccggggaaaaaacaagtcaatcatctgaagagactaaggtccgattaattgttaaaacggattctaataaaaccgatgaaaaagtcgctttcaaaaaaggtgctactgttatggatgtcttaaaagacaactataaagttaaagaaagcggtggttttatcactactattgatggtgtcactcaggataaaaaagcaggtaggtactggatgtttgatgttaatgataagctggcatcaaaagctgctgataagattaaggtcaaaaatggggataaaattgaattttatttgaaagtttataaaggtaagaactag

SEQ ID NO: 743 - DNA, 483 bp, Streptococcus mutans UA159
atgtcaaataaaccatgggaagaaaaagtaactgatgcaactactgataatgaagaaatgacaagaaattcaaaggatgctagtattatcagtacacctattttaacaatcctattgagcctctttttcttgattattattggtattttattttttgtactttatacttcaaatggtggaagcaatgaaaaagcagccacttcgggtttctatagttcttccaaaacggtcaaaaaagccaaaaatgaggcaaatagtcaaactgatgaacagacaacagaagcagaaacaagttcaagtgaaacgacaagttcctcttcagacagtgatggcgagacaattacagttcaaggaggtgaaggggctgcagcaattgctgcgcgtgcgggtatttctgttgataaactctatgagctgaatccagaacatatgacgcatggctattggtatgctaaccctggagataacatcaagattaagtaa

SEQ ID NO: 744 - DNA, 714 bp, Streptococcus mutans UA159
atgccagataatcgcatgaactatagtattgatagcaatatgcagtttcccttggtagaaattactttggaaacaggagaatttgcttatattcaacgcggtagcatggtctatcacacacccagtgtcactctcaataccaaagtcaatggacgtggttcaggacttggcaagctagtaggagcaattggtcgttctgtaacgtctggagaaagttttttcattactcaggcagtatcaaatgctagcgatggtaaattggccttggccccttctatgccgggccaagttattgctttagaattgggagaaaaacaatatcgcctcaatgatggtgcttttcttgccttagatggttctgctcaatatcaaatgaaagctcagagtgttggacgtgccctttttggcggtcaaggcggtctttttgttatgacaacagaaggtcaaggtaccttgcttgctaatagttttggttctatcaaaaaaatagaattacagaatcaggaaattacaattgacaatgctcatgttgtagcttggagtagggatttgaactatgacattcatttggaaaatggctttatgcaatcgatcggaaccggtgaaggcgttgtcaatactttccgaggaacgggtgaaatttatgtacaaagtcttaatctgcagcagtttgctggtgtcctacagggtttcattaccaatactaatcgttaa

SEQ ID NO: 745 - DNA, 687 bp, Streptococcus mutans UA159
atgaaaaaaaattatttttggtacggtctgcttgggcttctcgcactttaccttattactattgcttttatcccgggatttcatattttctttagcaacatgttgatgttggccctgttctttatgttaatagctttgagtaacaggagtatcttctttttctttctagccttaggttttcttagtatctacttgaaagatatctttcattttgactattctaccggaccgctttttacgggtataatcattatcggcgttattttaaacagtttcctcaaaccacactattcttattcttataaaggaaatcattattttaatatgaaacaacatgctaactacattgataacgaaacagatgtctttttaaaaacacttttttctgaaaataccagttatgtgacttctcaagaattaaataaaattattattgatactaagtttggagaacaatctgttgatctctctcaagctcaatttatgacagattctcccgaaattcatatagatgttagctttggtgaaaccaatctgcgtattccaaacaactggaaaatcatcaataaaactcactccccctttgcttccatttcattttcaggttttcctagcacaaatggtgattttattaacgttacattgactggaacagtggctatgggatctctaaacattcaatattaa

SEQ ID NO: 746 - DNA, 504 bp, Streptococcus pneumoniae R6
atgaaatcaataactaaaaagattaaagcaactcttgcaggagtagctgccttgtttgcagtatttgctccatcatttgtatctgctcaagaatcatcaacttacactgttaaagaaggtgatacactttcagaaatcgctgaaactcacaacacaacagttgaaaaattggcagaaaacaaccacattgataacattcatttgatttatgttgatcaagagttggttatcgatggccctgtagcgcctgttgcaacaccagcgccagctacttatgcggcaccagccgctcaagatgaaactgtttcagctccagtagcagaaactccagtagtaagtgaaacagttgtttcaactgtaagcggatctgaagcagaagccaaagaatggatcgctcaaaaagaatcaggtggtagctatacagctacaaatggacgttatatcggacgttacggttcatggactgctgctaaaaacttctggcttaacaatggctggtattaa

SEQ ID NO: 747 - DNA, 7656 bp, Streptococcus pneumoniae R6
atgaaacattcacataaaaaatcatttgactggtatagcatgcaacaacgttattctattcgtaagtattactttggtgcagctagtgtcttgctcggtaccgctttggtattaggtgcagcagctagtgtccaaacagtacaagcggaagaaaacaaacaagaaactaccaatagtatttctgttggtaggggagaagcagctactaaaccagcagaggtttctgcgtctaataaagagaaaacctatgcagctccaactgtagctaatccagtagaaacgactccagttaaaactgaagaagttactaaaccagcagaaaaagttgaagaagcaaaagacaaaaaagaggaagtaacgcatcaagatgccgttgacaagtcaaaattattaacggctctttcgcgtgctaaaaaattagaaagcaagttatatacagaagcaagtgctgctaacttgcaaacaagtatccaagctggtcaaagcttgcttggaaaagcagatgcaactgaagctgaattatcagcagcagagtcatctattcaatcatttattattggtctagaacttcgttctaactctaataaagaaactgtatcagaaacgcctgtagcgaagaaagctgatgcagttgaatcaaaagaaggggctaaaccagctgcaacaactgaacgttcagctgttgatagcgctattttgccaactagcacagctgacaaagtagaaacaacttcagctccagcatctattaatgaaatcttgaaactaggtttgagcctttctgatgctcgccaaaatccagctatccgtaaggaagatgttaatagagggtatagtggttttagagcggctagcaatccagccaacccaattgtctcaggttctggaaatacagttgcatttgcagatattagccaaggtggtcgtagctatagtttccgtggctacgggaactcacgtggtggaaattctattcattacgatgtaacaacagtacgtagtggtaatagtgttaactttacaattagttattctgcgccaggagattctagagagtttgttaataataattttatcttggataaaggggatggatttggaaatccttcaaatgcaacgatcacaagttcaaatccaagagtaagggagcaatcaaaatctattagtcagggtgccaactacgtatctcactcaggatacagtatgacctctgctatttcaacaaatacggaacaaactatcagatttagtttgcctatcattaatctaaatggtgatttgtctgttcgtttgaaacctgttacttttaacgtggaccaaggtggtggtggtgccgctactagcaatgacccatacagtaactctaactattattatagagcaaacccactatacttggatgcaaacccttatggtggtactaataataagactgtttcagaagacattgacttccaaactgtctatcttccaactagtaagttaccagaaggtcaaactagattagttcgagaaggtgaaaaaggacaacgtcaaattacctataaagttcatcgatttggtaacgaaacacttttaggattgccgattagtaatagtgttactaaagaagctaagccacgtattatgcaaattggtgtggctaaagatctaatcgatacagtaaaaccacgtgttgatcaaaataaagtcggtgatacaaataacctcactttctatcttgataacgatggaaacggtgtttatactgaaggtgtagacgaacttgttcaaaaaattgctattaaagatggagctaaaggtgaaaaaggagaccaaggtgaacgcggtctaactggagctaaaggtgaaaaaggagaccgaggcgaacgcggtctaactggagctcaaggagctaaaggtgaaaaaggagaccgaggtgaacgcggtctaactggagctcaaggagctaaaggtgaaaaaggagaccgaggtgaacgcggtctaaccggagctcaaggagctaaaggtgaaaaaggagaccgaggcgaacgcggtctaactggagctcaaggagctaaaggtgaaaaaggagcccaaggtgaacgcggtctaaccggagcacaaggagctaaaggtgaaaaaggggaccaaggtgaacgcggtctaaccggagcacaaggtgccaaaggtgaaaaaggggaccaaggtgaacgcggtctaaccggagcacaaggagctaaaggtgaaaaaggagcccaaggtgaacgcggtctaactggaactcaaggagctaaaggtgaaaaaggagaccgaggcgaacgcggtctgactggagcccaaggagctaaaggtgaaaaaggagaccgaggcgaacgcggtctgactggagcccaaggtgctaaaggtgaaaaaggagcccaaggtgaacgcggtctaaccggagcccaaggtgctaaaggtgaaaaaggggaccaaggcgaacgcggtctaactggagcacaaggtgaaaaaggagaccgaggcgaacgcggtttaactggagctaaaggtgaaaaaggggaccaaggcgaacgtggtatcactggagctaaaggtgaaaaaggagcccaaggtgaacgcggtctaaccggagcccaaggtgctaaaggtgaaaaaggggaccaaggtgaacgcggtctcactggagcccaaggtgaaaaaggagcccaaggtcaggcaggtcgtgacggtgtaactccaaccgtaaccgttaaagataataaaaatgacggcactcatactatcactattaacgacggtagaggtaatgttacaagtactgttgtaagagatggtttcgatggcgcaagtccattagttgcgactcaacgaaatgacgcagataagacaacaactgttatcttctattacgataaaaatggaaacaatgaattagatgcttctgataagaaattaaaagaagttgtaattgcagatggtgctaaaggtgaaaaaggggacaaaggtgaacaaggtcttcaagggcgtgatggtgaacaaggaccaaaaggagaagatgggaaaaccccaacagttaaagtaactgatggtcaagatggaacgcatacaattacaattaacgatggtaaaggtggtataactactacagtagtaagagatggatttgatggtgcaagccctcttgtttctactcatagaaatgaagcagataaaacaacaactgttattttctattatgatctaaatgataataatcaatttgatgaaggagatacaaaacttaaagaagttgttatcgcagatggaaaacaaggaccaaaaggtgacaaaggtgataacggaaaagatggattcacaccagaagtaacagttacagataacaataacggaacacacaccatcacaatcacacaaccagacaacagaccatcattaacaacaatcgttaaaaacggtgaagatggaaaaacaccaaaagtcaaagcagaacgagatgatgcgaagaaacaaacaacattaacattctacattgacaaagatggagatggaagttacacagcaggaaaagacgagttagttcaaacaacagtagttaaagacggacaagacggagctgcaggagcatctggacgtgatggaaaagaagtattaaacggaaaagtagacccaacaacagaaggtaaagatggagacacattcgtaaatacacaaacaggagatgtattcgttaagaaaggtaacacttgggaaccagcaggaaacatcaaaggaccgaaaggtgacaaaggtgcagatggtgccaagggtgaaaaaggagcccaaggagaacgcggcctgactggagcgcaaggtgtcaagggtgaaaagggagatcagggtgaacgcggtctaactggatctaaaggtgaaaaaggagaccaaggtgaacgcggtttaactggagcgcaaggtgccaaaggtgacaaaggtgaacaaggtcttcaaggtcgtgatggagctcaaggaccaaaaggagcagatggacaaagaggaccagcgggaccacaaggaccaaaaggagaacaaggtaatccaggaactccaggtaaagatggaaaatctctaattgctgttaaaaatggtgtattagtaacaattacaccagtagaaggtcgtccacaaacaacatttgtagaggatggacaaaagggtgctgatgggaaaactccaacagtaacaataactgaggggcaaaacggcacacatacattaacggttcataatccaggaagtccagatgtgacaactacgatccgtgatggagctacaggacaagcaggtcgtgatggtaaagatgtattaaacggaaaagtaaatccacaaccaaaccaaggtaaaaatggagataaatatattaatatcgaaaccggtgatgtctatgttaaaaacaatggaaactgggataaagaaggcaacatcaaaggccctaaaggtgacaaaggtgcagatggtgctaaaggcgaaaaaggagaccaaggcgaacgcggcctaactggagcgcaaggagctaaaggtgcggatggcgcagtaggtcgtgatggacgtgacggtaaagacgtgttgaacggcaaagctaacccagaagcacatcaaggtaaagacggcgataaatacgttaatacagaaacaggcgacgtcttcgttaagaataacggcaactgggataaagagggcaacatcaaaggccctaaaggtgacaaaggtgcagatggtgctaaaggcgaaaaaggagaccgaggcgaacgcggcctgactggagcgcaaggagctaaaggtgcggatggagcagcaggtcgtgacggacgtgatggacgtgacggtaaagacgtgttgaacggcaaagttaacccagaagcaaatcaaggtaaagacggcgataaatacgttaatacagaaacaggcgacgtcttcgttaagaataacggcaactgggataaagagggcaacatcaaaggctctaagggtgacaaaggtgaacgcggagaagatggtaagactccagaagtaactgtaactccaggtaaagatggccatagtactgacattacattcactgttccaggtaaagatccagttacagtaaatgttaaggacggagaaaatggtctgaacggtaaaactccaaaagttgatttacttcgtgtccaaggaaaaaacggaaatccatctcatacaattgtgacattctatacagatgaaaacaatgacggcaaatatacaccaggaactgatgaacttctaggttcagaaatgattaaagatggtgctaaaggcgcggacggacgagatggtaaatcattgcttactgtcaaggatggtaaagaaactaaagtttaccaagaagatccagctaacccaggacaaccattaaatccagaaaaaccacttgcggtaattagagatggagtagatggaaaatcacctacagttacagctgttcgtaaagatgaagcagggcataaaggtgtagaaatcactgttgataaccatgatggttcacaaccaactacagtctttgttcaagatggtgctaagggaaaaactggtgcaaccggtcaggatggacaaactcctacaatcactactcaacgtggacaagatggccaaagcactgttgtaactatcacaacatcaggtaaagatccagtaaccttcactgtaaaagatggtaagaatggtaaagatggccgtgcaccgaaaatcaaagtagaagatattacttcaccttcaagaattagacgcgatacagatgctgctgcaactccaacgcgtaacggtatccgtgttacagtttatgatgatgttaatgacaatggggtatacgacgaaggtgtcgataaagtattaaatagtaaagatatttataacggtatagatggacgtgatggttcagctccaactattactacaaaagataatggagatggaactcacactatcacagttcaaaacccagatggttctgaatcaacaacagttgttaaagatggtaaagacggtaaaactgcgaatatcactacaacagaaaacccagatggaagccacacaattacggtgacaaatccagatggttcaactaaagaaactgttgttaaaaacggtaaagacggtaagactcctaaagttgaagtaacggataacaacgatggaactcatactgttaaagttacagatggagacggcaatgttaccaacgctatcatcaaagatggtaaagacggtaaagctgcaacagcaacaactactgaaaatccagatggaagccacacagtaacaatcactaacccagacggaactaagaatgagtttgttgttaagaatggacgtgacggtgttgacggacgtactccaaccgcatctgttcgtgataatggagacggaagtcatacaatcgttattacaaatccagaaggtgtgacaactgaaaccacagttcgtgatggtaaatcaccaaaagtgactataactgatgaacaaaatggaactcataagatctctgttctaaatggtgacggaacaactactgaaacaatcattaaagatggtaaatcaccagtagcaacagttagagataaccaagatggtacttacactattcgtgtggaaaacggtaatggtactgtttctgaaaccacagttcgtgacggtaaatcaccaactgctaaggttgtggataatggagatggaactcacactatcacagttgtgaactcagacggaataactacaacaactacagttcgtgatggtagagaaccaaaacttgaagttattgataacaacgatggttcacacactattaaagtgacaggtgctgatggtaaaggaacgacaactacaatctttgatggtaaatcaccaaaagcgaacatcgttgataacggagatggaactcatacattaacaatcgtagattctgatggtcgtgaatacaaatctattatcaaagatggtaaagacggcaaagatagcgtttcaccaactgtaactgttaaaaataataacgatggaactcacgttgttacaatcactaatccagatggaagtaagacagaaatggtgattaaagacggtaaagatggtaaatcaccaaaagtttctgttgaagataatggtgatggtagtcatacaatcacaatcatcaattctgatggaactgtgacaaaaacagttattaaagatggcaaagatggtagagatggacgtgatggtcgagacggcaaagacggtaaagatggaaaatgtggatgccaagacaaaccagtaacaccatcaaatgacaaaccagttcctccaacaccaaatgtgccgacaccagaagtaccggttaaacctgtgccagcgcaaccaacaccaaatgtaccgacaccagaagtgccagtacaaccaactccagctgtttcaacaccagaagtaccggttaaaccagtaccagcggttccagaacaaccagtagtaccaacaccggctcaaccagcaactccagtaaatgctaacccagtagcaccaactacaggtaaagaaaaccgtggggacaaattacctgaaactggaagccaatctgattatatctctgttcttttaggtagcggtattctattgagcctatatgtaggacgaagaaaagaagattaa

SEQ ID NO: 748 - DNA, 1143 bp, Streptococcus pneumoniae R6
atgaagaaaagaatgttattagcgtcaacagtagccttgtcatttgccccagtattggcaactcaagcagaagaagttctttggactgcacgtagtgttgagcaaatccaaaacgatttgactaaaacggacaacaaaacaagttataccgtacagtatggtgatactttgagcaccattgcagaagccttgggtgtagatgtcacagtgcttgcgaatctgaacaaaatcactaatatggacttgattttcccagaaactgttttgacaacgactgtcaatgaagcagaagaagtaacagaagttgaaatccaaacacctcaagcagactctagtgaagaagtgacaactgcgacagcagatttgaccactaatcaagtgaccgttgatgatcaaactgttcaggttgcagacctttctcaaccaattgcagaagctccaaaagaagtagcatcaagttcagaagttacaaagacagtgattgcttctgaagaagtggcaccatctacgggcacttctgtcccagaggagcaaacggccgaaacaagcagtgcagttgcagaagaagctcctcaggaaacgactccagctgagaagcaggaaacacaaacaagccctcaagctgcatcagcagtggaagcaactacaacaagttcagaagcaaaagaagtagcatcatcaaatggagctacagcagcagtttctacttatcaaccagaagaaacgaaaataatttcaacaacttacgaggcaccagctgcgcccgattatgctggacttgcagtagcaaaatctgaaaatgcaggtcttcaaccacaaacagctgcctttaaagaagaaattgctaacttgtttggcattacatcctttagtggttatcgtccaggagacagtggagatcacggaaaaggtttggctatcgattttatggtaccagaacgttcagaattaggggataagattgcggaatatgctattcaaaatatggccagccgtggcattagttacatcatctggaaacaacgtttctatgctccattcgatagcaaatatgggccagctaacacttggaacccaatgccagaccgtggtagtgtgacagaaaatcactatgatcacgttcacgtttcaatgaatggataa

SEQ ID NO: 749 - DNA, 666 bp, Streptococcus pneumoniae R6
gtgacgattctaggaaaagatacagttcaacaatctgcgaaaggtgaatctgtaactcaagaagctacaccagagtataagctagaaaatacaccaggtggagataagggaggcaatactggaagctcagatgctaatgcgaatgaaggcggtggtagccaggcgggtggatcagctcacacaggttcacaaaactcagctcaatcacaagcttctaagcaattagctactgaaaaagaatcagctaaaaatgccattgaaaaagcagccaagaacaagcaggatgaaatcaaaggcgcaccgctttctgataaagaaaaagcagaacttttagcaagagtggaagcagaaaaacaagcagctctcaaagagattgaaaatgcgaaaactatggaagatgtgaaggaagcagaaacgattggagtgcaagccattgccatggttacagttcctaagagaccagtggctcctaatgctgctcctaagacaacaagtgcaccgcaagcaactgcaggaacaatgcaagatgttacctaccagtcacctgctggcaaacaattacctaacacaggttcagcatcaagtgcagcacttgctagtcttggtctagtggtggcaacaagtggttttgctttgctaggaagaaagactagacgtagaaaatag

SEQ ID NO: 750 - DNA, 408 bp, Streptococcus pneumoniae R6
atgatgacgacaggttgctctatgggagcctatcatgcactcaatttcttcctccagcatccagatgtctttaccaaagtgattgctctcagtggtgtttacgacgcacgtttctttgtcggtgattactacaacgatgatgctatttaccaaaactcgccagtagattatatttggaaccaaaacgacggctggtttattgaccgttaccgtcaggcagagattgtgctgtgtacggggcttggagcctgggaacaagatggtttgccatccttttacaagctcaaagaagcctttgacaagaaacaaattccagcctggtttgctgaatggggacatgatgtcgcccatgactgggaatggtggcgtaaacaaatgccttatttcctcggtaatctctatttataa

SEQ ID NO: 751 - DNA, 5304 bp, Streptococcus pneumoniae R6
atgaataaaggattatttgaaaaacgttgtaaatatagtattcggaaattttcattaggtgttgcttctgttatgattggagctacattctttgggacaagtccggttcttgcagatagcgtgcagtctggttccacggcgaacttaccagctgatttagctactgctcttgcaacagcaaaagagaatgatgggcatgattttgaagcgcctaaggtgggagaagaccaaggttctccagaagttacagatggacctaagacagaagaagaactattagcacttgaaaaagaaaaaccggctgaagaaaaaccaaaagaggataaacctgcagctgctaaacctgaaacacctaagacggtaacccctgaatggcaaacggtagagaaaaaagaacaacagggaacagtcactatccgagaagaaaaaggtgtccgctacaaccaattatcctcaactgctcaaaatgataacgcaggtaaaccagccctgtttgaaaagaagggcttgaccgttgatgccaatggaaatgcaactgttgatttaaccttcaaagatgattctgaaaagggcaaatcacgctttggtgtcttcttgaaatttaaagataccaagaataatgtttttgtcggttacgacaaggatggctggttctgggagtataaatctccaacaactagcacttggtatagaggtagtcgtgttgctgctcctgaaacaggatcaacaaaccgtctctctatcactctcaagtcagacggtcagctaaatgccagcaataacgatgtcaatctctttgacacagtgactctaccagctgcggtcaatgaccatcttaaaaatgagaagaagattcttctcaaggcgggctcttatgacgatgagcgaacagttgttagcgttaaaacggataaccaagagggggtaaaaacagaggatacccctgctgaaaaagaaacaggtcctgaagttgatgatagcaaggtgacttatgacacgattcagtctaaggttctcaaagcagtgattgaccaagccttccctcgtgtcaaggaatacagcttgaatggacatactttgccaggacaggttcaacagttcaaccaagtctttatcaataaccaccgaatcacccctgaagtcacttataagaaaatcaatgagacaacagcagagtacttgatgaagcttcgcgatgatgctcacttaatcaatgcggaaatgacagtacgcttgcaagttgtggacaatcaattgcactttgatgtgaccaagattgtcaaccacaatcaagtcactccaggtcaaaagattgatgacgaaagaaaactactttcttctattagtttcctcggcaatgctttagtctctgtttctagtgatcaaactggtgctaagtttgatggggcaaccatgtcaaacaatacgcatgtcagcggagatgatcatatcgatgtaaccaatccaatgaaagatctagccaagggttacatgtatggatttgtttctacagataagcttgctgctggtgtttggagtaactctcaaaacagctatggtggtggttcgaatgactggactcgtttgacagcctataaagaaacagtcggaaatgccaactatgtaggaatccacagctctgaatggcaatgggaaaaagcttataagggcattgttttcccagaatacacgaaggaacttccaagtgctaaggttgttatcactgaagatgccaatgcagacaagaaagtcgattggcaggatggtgccattgcttatcgtagcattatgaacaatcctcaaggttggaaaaaagttaaggatatcacagcttaccgtatcgcgatgaactttggttctcaagcacaaaacccattccttatgaccttggatggtatcaagaaaatcaatctccacacagatggtcttgggcaaggtgttctccttaaaggatatggtagcgaaggccatgactctggtcacttgaactatgctgatattggtaagcgtatcggtggtgtcgaagacttcaagaccctaattgagaaggctaagaaatatggagctcatctaggtatccacgttaacgcttcagaaacttatcctgagtctaaatacttcaatgaaaaaattctccgtaagaatccagatggaagctatagctatggttggaactggctagatcaaggtatcaacattgatgctgcctatgacctagctcatggtcgtttggcacgttgggaagatttgaagaaaaaacttggtgacggtctcgactttatctatgtggacgtttggggtaatggtcaatcaggtgataacggtgcctgggctacccacgttcttgctaaagaaattaacaaacaaggctggcgctttgcgatcgagtggggccatggtggtgagtacgactctaccttccatcactgggcagctgacttgacctacggtggctacaccaataaaggtatcaacagtgccatcacccgctttatacgtaaccaccaaaaagatgcttgggtaggggactacagaagttatggtggtgcagccaactatccactgctaggtggctacagcatgaaagactttgaaggctggcaaggaagaagtgactacaatggctatgtaactaacttatttgcccatgacgtcatgaccaagtacttccaacacttcactgtaagtaaatgggaaaatggtacaccggtgactatgaccgataacggtagcacctataaatggactccagaaatgcgagtggaattggtagatgctgacaataataaagtagttgtaactcgtaagtcaaatgatgtcaatagtccacaatatcgcgaacgtacagtaactctcaacggacgtgtcatccaagatggttcagcttacttgactccttggaactgggatgcaaatggtaagaaactttctactgataaggaaaagatgtactacttcaatacgcaggccggtgcaacaacttggacccttccaagcgattgggcaaagagcaaggtttacctttacaagctaactgaccaaggtaagacagaagagcaagaactaactgtaaaagatggtaaaattaccctagatcttctagcaaatcaaccatacgttctctatcgttcgaaacaaaccaatcctgaaatgtcatggagtgaaggcatgcacatctatgaccaaggatttaacagtggtaccttgaaacattggaccatttcaggcgatgcttctaaggcagaaattgtcaagtctcaaggggcaaacgatatgcttcgtattcaaggaaacaaagaaaaagttagtctcactcagaaattaactggcttgaaaccaaataccaagtatgccgtttatgtcggtgtcgataaccgtagtaatgccaaggcgagcatcactgtaaatactggtgaaaaagaagtgactacttataccaataagtctctcgccctcaactatgtaaaagcctatgcccacaatacacgtcgtaacaatgctacagttgacgatacaagttacttccaaaacatgtacgccttctttacaactggatcggacgtatcaaatgttactctgacattgagtcgtgaagctggtgatgaagcaacttactttgatgaaattcgtacctttgaaaacaattcaagcatgtacggagacaagcatgatacaggtaaaggcaccttcaagcaagactttgaaaatgttgctcagggtatcttcccatttgtagtgggtggtgtcgaaggtgtcgaagacaaccgcactcacttgtctgaaaaacacgatccatatacacaacgtggttggaatggtaagaaagtcgatgatgttatcgaaggaaattggtcactcaagacaaatggactagtgagccgtcgtaacttggtttaccaaactattccgcaaaacttccgttttgaagcaggtaagacctaccgtgtaacctttgaatacgaagcaggttcagacaatacctatgcttttgtagtcggtaagggagaattccagtcaggtcgtcgtggtactcaagcaagcaacttggaaatgcatgaattgccaaatacttggacagattctaagaaagccaagaaggcaaccttcctcgtgacaggtgcagaaacaggggatacttgggtaggtatctactcaactggaaatgcaagtaatactcgtggtgattctggtggaaatgccaacttccgtggttataacgacttcatgatggataatcttcaaatcgaagaaattaccctaacaggtaagatgttgacagaaaatgctctgaagaactacttgccaacggttgccatgactaactacaccaaagagtctatggatgctttgaaagaggcggtctttaacctcagtcaggccgatgatgatatcagtgtggaagaagcgcgtgcagagattgccaagattgaagccttgaagaatgctttggttcagaagaaaacggctttggtagcagatgactttgcaagtcttacagctcctgctcaggctcaagaaggtcttgcaaatgcctttgatggaaacttatctagtttatggcatacatcatggggcggaggagatgtaggcaagcctgcaaccatggtcttgaaagaagcaactgaaatcactggacttcgttatgttccacgtggatcaggttcaaatggtaacttgcgtgatgtgaaacttgttgtgacagatgagtctggcaaggagcatacctttactgcaactgattggccagataacaataagccaaaagacattgattttggtaagacaattaaggctaagaaaattgtccttacaggtactaagacttacggagatggtggcgataaataccaatctgcagcggaactcatctttactcgtccacaggtagcagaaacacctcttgacttgtcaggctatgaagcagctttggctaaggctcagaaattaacagacaaagacaatcaagaggaagtagctagcgttcaggcaagcatgaaatatgcgacggataaccatctcttgacggaaagaatggtggaatactttgcagattatctcaaccaattaaaagattctgctacgaaaccagatgctccaactgtagagaaacctgagtttaaacttagctctgtagcttccgatcaaggtaagacgccagattataagcaagaaatagctagaccagaaacacctgaacaaatcttgccagcaacaggtgagagtcaatttgacacagccctcttcctagcaagtgttagcctagccctatctgctctctttgtagtaaaaacgaagaaagactag

SEQ ID NO: 752 - DNA, 1353 bp, Streptococcus pneumoniae R6
atgaaattatataataaatcagaattacgttattctcgcattttctttgataagagaccaccagcttttgcgtttattctcattatttcaactgctattatcttaagcggtgcattggttggcgcagcttatatacccaaaaactatattgtaaaagcgaatggaaattcagtcataacaggtacagagttcctatcagcaattagttcagggaaggtagttactttacataagtcagaaggagatatggtaaatgctggagatgtcattatttcgttatcaagtggacaagaaggtttacaagcgagctctttaaataaacaattggtgaagttacgtgcaaaagaagctatctttcaaaaatttgaacaatcattaaatgagaaatacaaccgtatgtctaattctggtgaagaacaggaatattatgggaaagttgaatactacctatctcagttaaattcggaaaattataataatggtacccagtattcaaagattcaggatgaatatacgaagttgaataaaataacagctgaaagaaatcagttagatgccgacttgcaaactctacaaaatgaattgattcaacttcaacagcaaggagactccccttccttatcagatacgacatcagctgatgataaagctaagttagaaactaagatattagaaataacaacaaaaatcgaagcattaaaaacaaatattacttctaagaatagcgagattgatagtcaacaaagcaatattaaagatatgaaccgtacctataatgatccaacttctcaggcttataatatttatgctcaattagttagtgagttaggtactgctcgttcaaacaacaataaaagtattacagagcttgaggctaatcttggagtggcaacaggtcaagataaagctcatagtatattagcgccaaatgaaggtactctgcattatttggtacctttgaaacaaggaatgtctattcagcaggggcaaacgatagcagaagtttcagggaaagaaaaaggttactatgtagaagcttttgtacttgcgagtgatatttctcgtgtctcaaaaggagcaaaagttgatgttgctattactggtgtaaatagtcaaaaatatggaacactaaagggacaagtcagacagattgattcaggaacaatttcccaagaaacgaaagaggggaatattagcctctataaagtcatgatagaattagaaaccttaactctaaaacatggaagtgagacagtcgtcctccaaaaggatatgccagttgaagtgcggattgtctatgataaagaaacctatcttgattggattttggaaatgttaagtttcaagcaataa

SEQ ID NO: 753 - DNA, 6048 bp, Neisseria meningitidis Z2491
atgaataaaggtttacatcgcattatctttagtaaaaagcacagcaccatggttgcagtagccgaaactgccaacagccagggcaaaggtaaacaggcaggcagttcggtttctgtttcactgaaaacttcaggcgacctttgcggcaaactcaaaaccacccttaaaaccttggtctgctctttggtttccctgagtatggtattgcctgcccatgcccaaattaccaccgacaaatcagcacctaaaaaccagcaggtcgttatccttaaaaccaacactggtgcccccttggtgaatatccaaactccgaatggacgcggattgagccacaaccgctatacgcagtttgatgttgacaacaaaggggcagtgttaaacaacgaccgtaacaataatccgtttctggtcaaaggcagtgcgcaattgattttgaacgaggtacgcggtacggctagcaaactcaacggcatcgttaccgtaggcggtcaaaaggccgacgtgattattgccaaccccaacggcattaccgttaatggcggcggctttaaaaatgtcggtcggggcatcttaactatcggtgcgccccaaatcggcaaagacggtgcactgacaggatttgatgtgcgtcaaggcacattgaccgtaggagcagcaggttggaatgataaaggcggagccgactacaccggggtacttgctcgtgcagttgctttgcaggggaaattacagggtaaaaacctggcggtttctaccggtcctcagaaagtagattacgccagcggcgaaatcagtgcaggtacggcagcgggtacgaaaccgactattgcccttgatactgccgcactgggcggtatgtacgccgacagcatcacactgattgccaatgaaaaaggcgtaggcgtcaaaaatgccggcacactcgaagcggccaagcaattgattgtgacttcgtcaggccgcattgaaaacagcggccgcatcgccaccactgccgacggcaccgaagcttcaccgacttatctctccatcgaaaccaccgaaaaaggagcggcaggcacatttatctccaatggtggtcggatcgagagcaaaggcttattggttattgagacgggagaagatatcagcttgcgtaacggagccgtggtgcagaataacggcagtcgcccagctaccacggtattaaatgctggtcataatttggtgattgagagtaaaactaatgtgaacaatgccaaaggctcggctaatctgtcggccggcggtcgtactacgatcaatgatgctactattcaagcgggcagttccgtgtacagctccaccaaaggcgatactgaattgggtgaaaatacccgtattattgctgaaaacgtaaccgtattatctaacggtagtattggcagtgctgctgtaattgaggctaaagacactgcacacattgaatcgggcaaaccgctttctttagaaacctcgaccgttgcctccaacatccgtttgaacaacggtaacattaaaggcggaaagcagcttgctttactggcagacgataacattactgccaaaactaccaatctgaatactcccggcaatctgtatgttcatacaggtaaagatctgaatttgaatgttgataaagatttgtctgccgccagcatccatttgaaatcggataacgctgcccatattaccggcaccagtaaaaccctcactgcctcaaaagacatgggtgtggaggcaggcttgctgaatgttaccaataccaatctgcgtaccaactcgggtaatctgcacattcaggcagccaaaggcaatattcagcttcgcaataccaagctgaacgcagccaaggctctcgaaaccaccgcattgcagggcaatatcgtttcagacggccttcatgctgtttctgcagacggtcatgtatccttattggccaacggtaatgccgactttaccggtcacaataccctgacagccaaggccgatgtcaatgcaggatcggttggtaaaggccgtctgaaagcagacaataccaatatcacttcatcttcaggagatattacgttggttgccggcaacggtattcagcttggtgacggaaaacaacgcaattcaatcaacggaaaacacatcagcatcaaaaacaacggtggtaatgccgacttaaaaaaccttaacgtccatgccaaaagcggggcattgaacattcattccgaccgggcattgagcatagaaaataccaagctggagtctacccataatacgcatcttaatgcacaacacgagcgggtaacgctcaaccaagtagatgcctacgcacaccgtcatctaagcattaccggcagccagatttggcaaaacgacaaactgccttctgccaacaagctggtggctaacggtgtattggcactcaatgcgcgctattcccaaattgccgacaacaccacgctgagagcgggtgcaatcaaccttactgccggtaccgccctagtcaagcgcggcaacatcaattggagtaccgtttcgaccaagactttggaagataatgccgaattaaaaccattggccggacggctgaatattgaagcaggtagcggcacattaaccatcgaacctgccaaccgcatcagtgcgcataccgacctgagcatcaaaacaggcggaaaattgctgttgtctgcaaaaggaggaaatgcaggtgcgcctagtgctcaagtttcctcattggaagcaaaaggcaatatccgtctggttacaggagaaacagatttaagaggttctaaaattacagccggtaaaaacttggttgtcgccaccaccaaaggcaagttgaatatcgaagccgtaaacaactcattcagcaattattttcctacacaaaaagcggctgaactcaaccaaaaatccaaagaattggaacagcagattgcgcagttgaaaaaaagctcgcctaaaagcaagctgattccaaccctgcaagaagaacgcgaccgtctcgctttctatattcaagccatcaacaaggaagttaaaggtaaaaaacccaaaggcaaagaatacctgcaagccaagctttctgcacaaaatattgacttgatttccgcacaaggcatcgaaatcagcggttccgatattaccgcttccaaaaaactgaaccttcacgccgcaggcgtattgccaaaggcagcagattcagaggcggctgctattctgattgacggcataaccgaccaatatgaaattggcaagcccacctacaagagtcactacgacaaagctgctctgaacaagccttcacgtttgaccggacgtacgggggtaagtattcatgcagctgcggcactcgatgatgcacgtattattatcggtgcatccgaaatcaaagctccctcaggcagcatagacatcaaagcccatagtgatattgtactggaggctggacaaaacgatgcctataccttcttaaaaaccaaaggtaaaagcggcaaaatcatcagaaaaaccaagtttaccagcacccgcgaccacctgattatgccagcccccgtcgagctgaccgccaacggtatcacgcttcaggcaggcggcaacatcgaagctaataccacccgcttcaatgcccctgcaggtaaagttaccctggttgcgggtgaagagctgcaactgctggcagaagaaggcatccacaagcacgagttggatgtccaaaaaagccgccgctttatcggcatcaaggtaggtaagagcaattacagtaaaaacgaactgaacgaaaccaaattgcctgtccgcgtcgtcgcccaaactgcagccacccgttcaggctgggataccgtgctcgaaggtaccgaattcaaaaccacgctggccggtgccgacattcaggcaggtgtaggcgaaaaagcccgtgtcgatgcgaaaattatcctcaaaggcattgtgaaccgtatccagtcggaagaaaaattagaaaccaactcaaccgtatggcagaaacaggccggacgcggcagcactatcgaaacgctaaaactgcccagcttcgaaagccctactccgcccaaattgtccgcacccggcggctatatcgtcgacattccgaaaggcaatctgaaaaccgaaatcgaaaagctgtccaaacagcccgagtatgcctatctgaaacagctccaagtagcgaaaaacatcaactggaatcaggtgcagcttgcttacgacagatgggactacaaacaggagggcttaaccgaagcaggtgcggcgattatcgcactggccgttaccgtggtcacctcaggcgcaggaaccggagccgtattgggattaaacggtgcggccgccgccgcaaccgatgcagcattcgcctctttggccagccaggcttccgtatcgttcatcaacaacaaaggcgatgtcggcaaaaccctgaaagagctgggcagaagcagcacggtgaaaaatctggtggttgccgccgctaccgcaggcgtagccgacaaaatcggcgcttcggcactgaacaatgtcagcgataagcagtggatcaacaacctgaccgtcaacctagccaatgcgggcagtgccgcactgattaataccgccatcaacggcggcagcctcaaagacaacttgggcgatgccgcactgggtgcgatagtcagtaccgtacacggagaagtagcgagcaaaatcaaatttaatctcagcgaagactacattacccacaagattgcccatgccatagcgggctgtgcggcagcggcggcgaataagggtaagtgtcaggatggtgcgatcggtgcggctgtgggcgagatagtcggggaggctttgacaaacggcaaaaatcctgccactttgacagctaaagaacgcgaacagattttggcatacagcaaactggttgccggtacggtaagcggtgtggtcggcggcgatgtgaatacagcggcgaatgcggctaaagtcgcgattgaaaataacctattatctcaagaagagtatgctcttagagaaaaattgatcaaaaaagccaaagggaaaggcctattatctttagattggggcagcctgaccgaacaagaggcaaggcagtttatctatttgattgagaaagatcgatattctaatcaattgcttgaccgatatcaaaaaaatccaagtagtttaaataatcaagaaaaaaatattcttgcatattttattaaccaaacctctggaggtaacacagcttgggcagcttcgatactgaaaacgccccagtcaatgggtaatctcactattccttccaaagatattaataacaccttatcgaaagcctatcaaacattgagtcgttatgattcttttgattacaaatcagctgttgccgcacaacctgcactttacttattaaacggaccgcttggcttcagtgtcaaagcagctactgtggcagcaggaggatataacattggacagggagcgaaagcaatctctaatggagaatatctgcatggtacagttcaggttgttaatggcacattgatggttgcaggatctgtatctgcacaggctgcaatatcggccaagcctgcacctgttacccgttatctgagcaatgacagtgctcctgctttaagacaagctttaactgctgaaagccagagaatccgcatgaaactgccggaagagtatcgacaaatagggaatcttgcgatagcaaaaattgatgttaaaggattaccgcaaaggatggaagcatttagttctttccaaaaaggggaacatggatttatttcgttacctgaaacaaaaatttttaaacctatatctgttgataaatatcataatattgcctctcctcctagaggaacattaagaaatatagatggagaatataaattacttgaaactatagcacagcaactcggaaataatcgtaatgtatcaggtagaattgatctatttacagaattaaaggcctgtcaatcttgcagcaatgttattttagagtttagaaatcgctatccaaatattcaattaaatatttttacaggaaaatag

SEQ ID NO: 754 - DNA, 2283 bp, Neisseria meningitidis Z2491
atggacttaatccaaaccccgaataagcaatttgtcgacggcgaccgccgcacgcccggtactcccgtacccgcatggtggctgaaccagttacaaggcgagttgtacagcattttaaacgcggttggcattgagcctaacaaagccgaccatgcccaagtcttatcggccattaaaacgttggccgccgatgcttcgcaggttgccagtatcgatgctctgcgtaaatacagcggcacaggctatgtgaacgtcaacgcctatcacgccaatacaacagtgggcggcggcgtgtttgtggcggataaagccgataaatctaccgctgataacggctgtaccgttattgtttctaccgacggcacgcgctggaagcgtgtgttttcagggatgcttaacctgcatgattttggatatgtggccagcaaaaacaatgcactatccactttgaatgccgctgaatctgccgcgcttgacgtagttgttgattgcttgggtttgtcaattgatacgggtaatatctacccgcaaaaaaacaaatacacaaacggcaagtttgtgattaacggcaaaactgtcgatgttcaataccagcctatcagaagcggtatcggtcgattcatctccggaactggtgcagcagccaacctcaaatcgaatgaatggactggcgcgggtttaatcgttattggcgaaggcgcaatggagcagatggagaaatgtgtttcctcaatcgctattggcgaccgtgcgcagggcttttctaaagtaagcagggacaacatcgccattggggccgacagcctgattaatgtgcaggccgctactgaatggtacgaccagtcacgcatggaaggcacgcgcaacatcggtattggtggtaatgcaggacgcggcatcaccagcggttactctaatgtgtcaatcgggcgcaatgccggacagggattgggtgaaggctcgtcaaatattgcacttggcgcaggcgcgatggctggtactgctccagtcggttttagtggcgacattgaagttttttggccgtcttcgacctcaagaacaatcgcaatcggcgaggctgtcttgcaaacatatcagggccgcgccgctcaaaccgcaattggtgccaatgcggcgcgaaatacaaaaaaggccgaaaaagttaccgcaatcggttctgccgcgatggagaatcttgagcgaaaccgcgccccaaatggcggagatgttgtctggacgggaacggaagcaggtacctacgcccaatctggaaaaaacatcacgcttacatttcccaacattcgcggtgcgcaagcgacttattgggtgggcatccgccttacatcaggcacggcgcaaaccttacaaaacgacgtcgtaccggctcaggtcgtatcagtgaatggcaatacattaatcatccaaagctcaaaagagctgaccgccaccggcgcggccgaactgaaatacgtttattctgtaaattcaaccgctactaaaaacgaagagttgaccatcatcggcgcgaacgccatgaataaggcattgaccgcaggatactcaactatcatcggcgtagatgccgcgttgttgggagacaattatcaaaaaacaaccgcaatcggcgcatcatctttacgaacaggtagtcatatttccacaactgctattgggtattgggtaatccctttggcaagtagtgagaaatgtgttgccattggagatagtgcgggctatcggaacgttcaaggcgactttttgactgggaaaataacaaactccatcgccatcggatatggcgcaagaataaacggcgataacgaaatccaaatcggtacgacagggcaaactttatatgctccaaccgcggtgaacatccgttctgacggccgcgacaaagcagatgttaagccgttgacgaacggtttagattttgtaatgaagctcaagccgatgactggctactacgaccgccgggattcctacgttgacgaattattcaaagacttgccggcagatgaacgagcggacaaagtccgcgaatggtgggcgaatccaatcaaggacggcagtcataaagaagatcggttgcggcattggtttattgcccaggacattgctgcgctggaagatgaatatggtcgattgccgatggtaaataaaacaaacgatacctacaccgtcgaatacgaaacgttcatccccgttttgactaaagccattcaggaaatggccgcaagaattgaaacattagaaaccgaaatgaaggaatcgaaaaaatga

SEQ ID NO: 755 - DNA, 1083 bp, Streptococcus pyogenes MGAS8232
atgaaaaatatctcacgcaaatgctttatgaccagtgtggtatgtattattctaggaggcattcttctaggggctggctatgcaactggaggacttcaggacattaaacaccaaacagctcccaaaaaggtcatcaaaacatttgaccaaataactgctcttgatattgacagttctgcctcaactattacagtagagacaggacccgttcaaagaccaacagtgacctattacacacatcctaaatttattgaccctatcgtcacaacattaacaggtaagaccctatctctttcgcaaaaacccaaagacattgtcatcactggtggaattgaaattttaggttttactctcaataatagtcgtcaagagaagaactaccgttctattaccattactgttcctgaaaaaactagcctcaatgaagttaagggaagtaatgtcccacataccactttgtcaaatctaactgtccaagatatgcaattcgatggcaatcttactcttttacataccaaagtcaagaaagctactatcactggtatgttggaagccactaaaagtcagttaacaaatctcgagttaaaagctgactattctttttcaaacctgactgattctagtgtggaaaatgggaccatcagcttaggaaatggacaactaactactaaagataccactctaaaagccatcaatattcaatcattacaccctggcggtatagaagccgagagaacaacccttgaaaatgtgaccttcactgtttctaaaagcaaagaagaagaagaggagaacgactactatgacaatgatgctatcttcaccgctcatgcccttacccttaaagggactaatactattagtggtggtgatattgatgttgacataaccttgacaaaagcaaaggccatcgcctacagggcaaggaccgaaaatggtaaagtctcccttggctcacagctgacaccagctaagattggtaaggaatcaacttcagatgttatttcttatgtggctgagaataaagcagctactggaaatttaacggttaatctcaataagggagacattactatcaaatga

SEQ ID NO: 756 - DNA, 615 bp, Streptococcus pyogenes MGAS8232
atgtttaagaaagaaaatttaaaacaacgttattttaattttggattagtagcgttagctctaacaatattagccatcatttttgccttctcaagtaaaaatgctgatactaagtcttatgctaagaagtcagaaagtaaaatggtaacaatcgacaaggctccaaaaaataatcatgctattactaaagaagaaagcaaagaaaaagcaaagagcattgcttcggagcctattcccacagtagaaaactctgtagctccgacagtaacagaggaagcaccggttgttcagcaagaagtgactcaaactgttcagcaggtatcttcagtagcctataatccaaataatgtggtactttccaatggaaatactgctggtattgtaggaagtcaagcggcggcacagatggcagcagcaacaggtgttccacaatcaacttgggaacatataattgcgcgtgaatctaatggaaatcctaacgcagctaatgcttctggggcatcagggttgttccagacaatgccaggttggggttctacagcaacggttgaagatcaagtcaatgcagccttgaaagcctatagtgcacaaggtttatcagcttggggttactaa

SEQ ID NO: 757 - DNA, 2274 bp, Streptococcus pyogenes MGAS8232
atgttagaagaattgaaaacacttattaaaaatccaaaattaatgattacaatgattggtgtggccctagtgcctgccttatataatttatcctttctaggctcaatgtgggatccttatggtcgggtcaatgaccttcccattgctgttgttaatcatgataagcctgcaaagagagctgataagtcattgacaattgggaatgatatggtggacaagatgtctaaaagtaaagatttagactatcattttgtatcttcaaaaagtgctcaaaaaggtcttaaaaaaggtgattattatatggtcattactttacccgaagatctttctcagcgagcaacaaccttattaaatcccgaaccccaaaaactaactatccgttaccaaactagtaaaggacatggaatggtcgctgctaagatgggggaaacagcgatggctaagctgaaagagtctgtttcgcaaaacattacgaagacttatacctcagcagtttttagcagtatgacagacctccaatcaggattaaaagaagcctcaactggtagtcaagcattggattcaggagcgaagacagcccaaatgggtagtcaaatgctctcagataacttagcaggtttatctagtgctagttggcaatttcaacaaggaactaatcgtttaacttcaggattaacggcctatacagctggtgttagtcaagtaaaggacggactagggcagctctcaaccgatatgccagtttacctgaatggggtttctcggttatcacaaggagcttctcaacttaatcagggtctttcacagttgacacaatcaacaacactttctgatgataaagctaaaagaatccaatctttggaggtaggattaccagttttaaatcaaggtattcagcaactaaatgaaaatctctcaacgatgcaggtaccaaaacttaataccgatgagttagggaataacttggctgccattgctcaagctgcgcaacagttacttgttaaagaagctgctgctcacaaggaacaactagcagtcttacaagccactagcgcttatcagtcactaactgctgagcaacaaggggaattaactgctgctcttacccaaactgataagggtgaagctgtggctcctgctcaaacgattttaaggtctgttcaaactttgtcaacaagtttacagtctctctctcaagaagatcagtcaaaacagttggagcaacttaaggaagctgttgcacagattgctaatcaatccaatcaagctttgccgggagcaagttctgctttaactgaattatcaacgggattagcaaaggtaaatggtagcttaaatcaacaagttctaccaggaagtaatcaattgacaacaggattagcacaattaaacaggtataatactgccattggttctggggtaataaaactctcagaaggtgccaatgccttgtcatccaagtccggagaattactagatggtagccatcaattatcagaaggtgctactaaactagctgatggtagttctcaattgagtcagggtggtcatcaattaacgagcggattgactgaattatcaacaggattgtcaatcttaaatggttccttagccaaagcctctcagcagttatcgcttgtttctgtgactgataaaaatgctaaagctgtcgcaaaacctcttgtgttaaatgagaaagacaaagatggtgttaagacgaatgggatcgggatggcaccttatatgattgctgtttctctaatggttgtggccctttcaaccaacgtcatttttgctaattctttatctggtcgtccggtcaaagataaatgggattgggctaaacaaaaatttgttattaatggttttatttcgactatgggatccattgttctctacttagctattcaattattagggtttgaagcccgttatggtatggaaaccttaggatttattatgctaagtggttggacgtttatggctcttgtcacagctttggtcggttgggatgatcgatatggctcttttgcttctttggttatgttattgcttcaggttggctcttcaggtggctcttaccccattgagttaagtggagcatttttccaaaagttacatcctttcttaccaatgacttatgtggtatctggtttacgacaaaccatttcattatcaggtcatattggagtagaagtgaaagtcttaactggtttcttactggcatttatggtattatcactactcatttatcgtcccaagaaaacagtctaa

SEQ ID NO: 758 - DNA, 1785 bp, Streptococcus pyogenes MGAS8232
atgagcagagacccaacatatacaataaacgagcacgacttatcttttgcagatggtcgtttttatgtgacctttaaggcagataagtcaagtgagactgtgagacttaacagtagttgccttggcaataccataatcaaaaagctacaggtcgaggatgacaatacaatgcacgactttgtaaagcctaaagttaccactcaacaagcttttggactagctcagcaggtcaaagagcttgatttacagctaaaagaccctaagtcagatttgtggggcaaaatcaagttcaataataaggcaatgctagtcgagtacgccaacaaagagatgtcaagtgccattgcgcaatcagctgagcagatattgttacaagtcaagtctattgatgatgaacgatattccaaatttgagcaaactctgaatggtatcaaacaaactgtcaaaagtgagtcagttgaatccgcacgtactcagctagcatcaatgtttgatagtcgtattagtggacttgatggcaaatacagtcgtttgagccaaacaattgatagtcttagcagtcgtcttgatgatggtgttggtaactactcaacgctatctcaaaaggtaagtggcattgatttacgagttagtaatgcagctaatgatgtttctcgattgtctcagacagcacaaggattgcagtcacaaatcacaaatgcaaaccaaaattacagcagtttgtctcagactgtacagggactacaaacaactgtacgtgataatcaatcaaatgctacaagtcggattaatcagttaagtgacctgatcagcacaaaggtatcaaaaggtgatgttgagacaactattgctcagagttacgacaagatagccttcgcaatcagggataaactcccagcaagcaaaatgtctggcagtgagattatctcggcaatcaatcttgataggtctggggttaaaatcactggaaaaaatatcactcttgatggtaacagctacatcagcaacgctgtcatcaaagatgctcatattgctaacatggatgccggtaagattaatactggttatcttaatgctaataggattgcaaccgaggccattactggtgagaaaattaagatggactatgccttttttaataaactcactgctaacgagggatattttaggacgttgtttgccaaagacatctttgcaacatcagtccaatctgtaacactatcagctagcaaaattactggaggtgtattagccgctacaaatggggcaagtcagtgggacctaaataatgccaatatgacctttaatcgagatgccacaattaattttaatagcaaaaacaatgccttagtacgtaaagatggcacacatactgcttttgtacattttagtaatgccacaccaaaaggctatagaggctcagcgttgtatgcctctatcggcattacctcatcaggagatggcatcgacagcgcttcttccggtcgttttgcagggctaaggtcatttaggtacgctacgggatataaccatactgctgcagtcgaccaaaccgagctatacggtgataatgtcttgattgcagatgactttagcatcaatcgaggatttaaatttagaccagacaaaatggaaaaagtgctcgacatgaacgacttgtatgcggctgtagtagccttaggccgctgttgggggcacttggctaacgtcggctggaatactgctcatagcaattttacaagtgctgtgagtagggaattgaataactacatcactaaaatttaa

SEQ ID NO: 759 - DNA, 3261 bp, Streptococcus pyogenes MGAS8232
atggcagctgatggtaaggtaacgatacttgttgacgttgatggtaagcaggtaaaggtactcaatagtgagttagataaagttgccaagcacggtgacaaaggcagctcctctcttaaaaaatttgcggttggtgcaggagtctttaaattagcttcggctgcagttgatttggttagtcaatctcttggcaaggctatcacaagatttgacacgcttgaaaaatatccaagggtcatgaaagctatggggcatagcgctgaggatgttgctagatcaactgataagttagcgaacggaattgatggactaccaacaactttagacgaggttgtcggaaccgctcaacgtttgacctctattactaaggatatcaataaatcaactaatctcacactagcattaaataatgcctttttagcttcaggagcttcatcagaggctgcaagccgagggctggagcaatatgcccaaatgctatcagctggtaaggttgatatgcaagcttggaaaaccctccaagaaacaatgccttatgccttacaacaaactgcggaagcttttggatttgcaggggcatcggctcaaaaggatttttatgaggcgttaaaaaacgggcaaataacatttgaccaattttctaataagttgattgagttaaatgatggtgtcggcggttttgcagaactagccaaagaaaatagtaaagggattgaaacctcttttaacaacatcaagaacgctattgcaaaaggtgtggccaatagcattaaggctttggatgatttgtctaaggctgcaacaggtaagggcatagctgatcattttgatagtttgaaagttgttatcaatgcctcttttagcgccatcaatgcaagtattaaagctagtacaccgctatttaaacttttgtttagtgttattggtgctggaatatcagtcgtcaaagctctgtcgcctgccttagttggtgtagcatctggtctagctgccatgagggcagttaatgagactataacaatgattaaagcgctaaatagagcttgggttatggcatctgcatcaatgagtattggagcaacaaccattaagactgtgactgcggtacaagcggtaagtaccacgatgactaaagcagatatggttgcaagactatctcagttaggtgtcttaaaagccagtaccgtgatttatggtgttatgacaggcgctatcagtttatctactgctgcaaccatagccagtactgctgcggtaactgcgttaaaagcagcacttgtagccttaacaggtcccgttggttgggtagttggagctatcggtgctttagttgctgtcggagtaagcttatggtcatggctaactaaagagtcagacgagaccaaaaagctgaaaaaagagcaggaggggctagtcgaaagcaacaaacagctaagagattctgtccgtgagggcgtgcaagagcgtaagaagggccttgagtccgtcaaagagagcactgcagctcatcaaaaattagctgacgaaatcattaagttagccgccaaagaaaacaaaactgcaggcgaaaaacaaaacttaaaaaataagattgatcagcttaatgggtctattgatggcttaaacttggcctatgacaaaaactccaattctctttctcacaatgcagatcaaattaagtcacgcattagtgccatggaagcagaaagcacatggcaaacagcacaacaaaatctgttaaatattgaacagaaacgtagcgaggttagcaaaaagctagctgaaaatgctgatttgcgtaaaaagtggaatgaagaagctaacgtctccgattccgtccgaaaagaaaagattgcagaactcacagaagaagaagctaaacttaaaaatatgcagactcaactgcaggaggagtataacaagacatcagctactcaacaagctgctgcagacgctatggctgccgctgaagaatcaggatcagcaagacaggttatagcgtacgaaaatatgtcagaagctcaacgaactgccatagacaatatgcgcactaagtactctgaacttttagagacaacgacatctatttttgatgctatagaacaaaagacggcattatcagtagatcaaatgaataccaaccttgaaaaaaatagagctgctactgaacagtgggctactaatttggagattttggctcagcgtggtgtggatcaaggtattttggagcaactaagacgcatgggtcctgaaggagccacacagacgcaagtttttgtggatgcaacagatgccgagctagcacccttgcaggaaaactttagagcagccacagaaactgctaaaaatgcaatggggagcgttttagactcagcaggtgtggaaatgccagaaaaagttaaagggatggtcactaatgtttctacgggattacaggcggaactgcaagctgctaactttgctcaacttggccaagaaatccctaatggggtttctcaaggtataagtcaaggggcaggtaaagcaagtgacgcaagtgtcaaaatgggtcaagaagttaaacgctcttttcaaggagagttgggtatccactcgccatcgcgagtatttactgagtacggtggccatattactgatggcttgagtaatggtgtgacaaatggaacgtcaaaagttatgcaaaccatgcagagcttggctcaacagatgtctcaaaaaggacagcagattgttaatgacatgcgtagcaagtcgaaccaaatcacagatgcttttagcacgatgagtggtccaatgcactctcatggtgttaatgccatgcaaggtttggccaatggtatttatgcagggtcgggggcagctttagcggcagctcaaagcattgcggcacgtatcaccgcaacaattcaaagtgccttagatatccactcgccatctcgtgttatgagggatgaggttggacgttttatccctcagggtatcgctgtaggtattgatgcggatagaaaagtcattgactcatctatgcaaaagctaaaagagtcaatgacgattaatgcgactccagaaatagcctctggatttggcggaggagttgcggggattgctaatcagaccacaaataactcaaataacagttttacccttaatgtcaaggttgatgaatccgacggtaatagccacgagaaatatcaacgcttattcagagaatttagctggtatattcaacaacaacaaggaaggttaggtgatgttaaatga

SEQ ID NO: 760 - DNA, 477 bp, Streptococcus pyogenes MGAS8232
atggctaaagaaccatgggaagaaaaaattgttgatgatactatagggacacgaacacgtaaatcaagaaatgctttcattagcacgccttggttgactgctttattaagtgtattctttgtcatcattgttgctatactttttattttcttctatacatcaaatagcggtagtaatagacaagctgaaacaaatggtttttatggagcatccactcataaaaaaacaaggaaagcttctaacgctaaaaaaacatcaagtagttcaacaactacagacacaacaccttctagcgaagaaacacttgcttctagtgaaggaaccggcgaaacccttactgtattggcaggtgagggggcagcttctattgcagctcgtgcaggtatttctgtggagcagttacaagcacttaatccagagcacatgactcaaggatattggtatgccaatccaggagatcaagtcactattaaataa

SEQ ID NO: 761 - DNA, 1272 bp, Streptococcus pyogenes MGAS8232
atgtctaaaagaggaaaaattaaaataacaacgaaaacaaagcttattacagctagtgttataacgctagtattaattataactggagtagtcttgtggaaacaacaacaaaatacgctaacagctgatatcgctaaagaaccttactctactgttagtgtaactgaagggagtattgcttcttcgactttactatcaggtactgtaaaggctttatcagaggaatatatttattttgatgctaataaaggaaatgatgcaactgttacagttaaaataggtgatcaggtaacgcagggccagcaattagttcaatataatacaacaacagctcagtcagcttatgatactgctgttaggagtcttaacaagattggccgacaaattaatcatcttaaaacatacggagttcctgctgttagtacagaaactaataaagatgaagctaccggtgaagagacgacaacaacagttcaaccatcagctcagcaaaatgctaattataaacagcagctgcaagatttaaatgatgcttatgcagatgcacaagcagaagtaaataaagcgcagatagcgttaaatgatacagtagttatcagtagtgtctctggaactgttgtggaagtaaataatgatattgatccttcttcaaagaacagtcaaacacttgttcacgtagcaaccgaaggacagcttcaggtgaaaggaacattgacagagtatgatttagcaaacgttaaggttggtcaatctgtaaaaattaagtctaaagtttattctaatcaagaatggactggaaaaatatcatatgtttcaaactatccaactgagtctaatgcaggttcaacaacgccagcaggtagcactggagcgggaagttctacaggagctgcctatgattacaagattgatattataagtcctcttaaccagcttaaacaaggtttcactgtttctgttgaggttgttaatgaagctaaacaggccttagttcctttaacggctgttattaagaaagataaaaaacactatgtttggacttatgatgatgctactggcaaagccaaaaaagtagaggtgacacttggaaacgcagatgcacaacaacaagaaattcataaaggagtagctgttggtgacattgttattgccaatccagataaaaatatcaaaccggataaaaaactagaaggggttatttcaataggtaccaacacaaaaccggaaaaagattctcaatcaaagaataaaaaatcaggggtggataaatag

SEQ ID NO: 762 - DNA, 1227 bp, Treponema pallidum subsp. pallidum str. Nichols
gtgctccgcttgccaactgcgcgcgcgtgcattacaatgggcaccatgatcagacatacatttacgcataggtgcggagcgctcctgtgcgcgctggcgttgggaagctccactatggctgcgaccgccgctgcaaaacccaagaaagggcaaatgcagaaattgcggcagcggccggtgtgggcgcccaccggcgggcggtatgcgtctttggacggtgcgtttaccgcgctggcaaatgatgcaagtttctttgaggcaaatccggcaggaagtgcgaacatgacgcacggggagctggctttcttccataccactggctttggctcgtttcacgccgaaacgctctcttacgttggccagtcgggcaactggggatacggcgcgtcgatgcgtatgtttttccctgaatctgggtttgacttttctaccaccacggagcccgtgtgcacacctgcttcgaaccccattaagcagcgcggggcaattggaatcatcaactttgcccggcgtatcggaggtctctccctgggagccaacctgaaggcggggttccgcgacgcgcagggcctgcagcacacctctgtctccagtgacatcggcttgcagtgggtggggaacgttgccaagtcctttacctctgaagagcccaacctgtacatcgggcttgcggccaccaacttgggattgaccgtaaaggtctcggacaagatagagaactgcacgagtacctgtgaaaagtgtggttgctgcaaggagaggtgctgctgcaacggcaagaaggcgtgctgcaaggactgcgactgtaactgcccctgtcaggactgcaacgacaaaggtacggtgcacgcaacagacaccatgctgcgtgcagggtttgcataccggcccttcagctggttcctctttagccttggtgccaccaccagcatgaatgtgcagaccttggctagtagtgacgccaagtcgctgtaccagaacctggcttacagcataggcgccatgtttgatcccttcagcttcctgagcttgagttcgagcttccgcatcaaccacaaggctaacatgcgagtgggagtgggtgcagaggcgcgcattgcccgcattaagctgaacgcgggataccgctgtgacgtcagcgacatcagcagtgggagtgggtgcacaggcgcgaaggcttcgcactacctttccttgggtggcgcgatactgctcggccgaaattaa

SEQ ID NO: 763 - DNA, 660 bp, Treponema pallidum subsp. pallidum str. Nichols
atgagcagaacgttccgcgcgtggcagtgcgttggtgcgctgtgtgcgctctctcccctgctgcctgcctacagctccgagggcgtgcgagaggtacccccctcccagtctccgcaggtggtggtggcgtacgagcccattcgccccggggatcagctgctcaaaattggcattgttgcaggctgccagttgtacatagcagggggaaatggaaccaacggctcttcgagttccggcaccaacggtaacggcaacggcaaactgctcgggggcggggggtttcacctcgggtacgagtatttttttaccaaaaacttttccctcggcgggcaagtttcctttgagtgttaccgcacgaccgggtcaaactattacttttctgttcccatcacggtaaaccccacgtacacgtttgccgtagggcgctggcgcataccgctctccctgggcgttgggctcaacattcagtcctatctcagcaagaaggcgccggggcttattgcggaagccagcgcggggctctactaccagtacaccccggactggtccatcggcggcattgttgcctacacgcagcttggggacattgcaagctcccccgacaagtgcagagccgtgggccttgccaccattgactttggggtgcgctatcacttttag

The invention claimed is:

1. A computational method for identifying adhesin proteins, said method comprising steps of:
  a. computing the sequence-based defined attributes of protein sequences using five attribute modules of Software for Prediction of Adhesin and Adhesin-like proteins using Neural Networks (SPAAN), (i) amino acid frequencies, (ii) multiplet frequency, (iii) dipeptide frequencies of NG, RE, TN, NT, GT, TT, DE, ER, RR, RK, RI, AT, TS, IV, SG, GS, TG, GN, VI and HR, (iv) charge composition, and (v) hydrophobic composition,
  b. training artificial neural Network (ANN), one network for each of the computed five attributes by feeding the input data into the input layer of neurons,
  c. identifying as an adhesin a protein having a weighted average probability of being an adhesin ($P_{ad}$) value (optimal threshold) of $\geq 0.51$, and
  d. outputting sequence of identified protein to the user.

2. A method as claimed in claim 1, wherein the protein sequences are obtained from pathogens, eukaryotes, and multicellular organisms.

3. A method as claimed in claim 1, wherein the protein sequences are obtained from the pathogens selected from a group of organisms comprising *Escherichia coli, Haemophilus influenzae, Helicobacterpylori, Mycoplasma pneumoniae, Mycobacterium tuberculosis, Rickettsiae prowazekii, Porphyromonas gin givalis, Shigellaflexneri, Streptococcus mutans, Streptococcus pneumoniae, Neisseria meningitides, Streptococcus pyo genes, Treponema pallidum* and Severe Acute Respiratory Syndrome associated human coronavirus (SARS).

4. A method as claimed in claim 1, wherein the method is a non-homology method incorporating compositional properties and trained artificial neural network.

5. A method as claimed in claim 1, wherein the method uses 105 compositional properties of the protein sequences consisting of 20 properties each of amino acid frequencies, of multiplet frequencies, of dipeptide frequencies, of charge composition and 25 properties of hydrophobic composition.

6. A method as claimed in claim 1, wherein the method shows sensitivity of about 90% wherein sensitivity is greater than 90% for a Pad value above the optimal threshold.

7. A method as claimed in claim 1, wherein the method shows specificity of 100% wherein specificity is 100% for a Pad value above the optimal threshold.

8. A method as claimed in claim 1, wherein the method identifies adhesins from phylogenetically distantly related organisms.

9. A method as claimed in claim 1, wherein the neural network has multi-layer feed forward topology, consisting of an input layer, one hidden layer, and an output layer.

10. A method as claimed in claim 9, wherein the number of neurons in the input layer are equal to the number of input data points for each attribute.

11. A method as claimed in claim 1, wherein the "$P_{ad}$" is a weighted linear sum of the probabilities one each from five networks.

12. A method as claimed in claim 1, wherein each trained network assigns a probability value of being an adhesin for the protein sequence.

13. A computer system for performing the method of claim 1, said system comprising a central processing unit, executing SPAAN program, giving probabilities based on different attributes using Artificial Neural Network and in built other programs of assessing attributes, all stored in a memory device accessed by CPU, a display on which the central processing unit displays the screens of the above mentioned programs in response to user inputs; and a user interface device.

* * * * *

UNITED STATES PATENT AND TRADEMARK OFFICE
CERTIFICATE OF CORRECTION

PATENT NO. : 7,424,370 B2 Page 1 of 1
APPLICATION NO. : 11/052554
DATED : September 9, 2008
INVENTOR(S) : Gaurav Sachdeva et al.

It is certified that error appears in the above-identified patent and that said Letters Patent is hereby corrected as shown below:

On the Title Page:

Add field -- (30) Feb. 6, 2004 (IN) 173/DEL/2004 --.

In the Specification:

At Column 1, line 11, "06/589,220" should be -- 60/589,227 --.

In the Claims:

At Column 37, line 64, "Helicobacterpylori" should be -- Helicobacter pylori --.

At Column 37, line 66, "gin givalis" should be -- gingivalis --.

At Column 37, line 66, "Shigellaflexneri" should be -- Shigella flexneri --.

At Column 38, line 39, "pyo genes" should be -- pyogenes --.

Signed and Sealed this

Twenty-third Day of December, 2008

JON W. DUDAS
*Director of the United States Patent and Trademark Office*